US009187762B2

(12) United States Patent
Albert et al.

(10) Patent No.: US 9,187,762 B2
(45) Date of Patent: Nov. 17, 2015

(54) COMPOSITIONS AND METHODS COMPRISING SEQUENCES HAVING HYDROXYPHENYLPYRUVATE DIOXYGENASE (HPPD) ACTIVITY

(75) Inventors: Henrik Albert, Alameda, CA (US); Ericka R. Bermudez, Aptos, CA (US); Linda A. Castle, Mountain View, CA (US); Yuxia Dong, Fremont, CA (US); Matthew J. Heckert, San Carlos, CA (US); Jingtong Hou, San Pablo, CA (US); Zhenglin Hou, Ankeny, IA (US); Jian Lu, Union City, CA (US); Daniel L. Siehl, Menlo Park, CA (US); Yumin Tao, Ames, IA (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 979 days.

(21) Appl. No.: 13/208,966

(22) Filed: Aug. 12, 2011

(65) Prior Publication Data

US 2012/0042413 A1    Feb. 16, 2012

Related U.S. Application Data

(60) Provisional application No. 61/401,456, filed on Aug. 13, 2010, provisional application No. 61/393,507, filed on Oct. 15, 2010, provisional application No. 61/501,042, filed on Jun. 24, 2011.

(51) Int. Cl.
| | |
|---|---|
| C12N 15/00 | (2006.01) |
| C12N 5/10 | (2006.01) |
| A01H 5/00 | (2006.01) |
| C12N 15/82 | (2006.01) |
| C12N 9/02 | (2006.01) |

(52) U.S. Cl.
CPC .......... *C12N 15/8274* (2013.01); *C12N 9/0069* (2013.01); *C12N 15/8221* (2013.01)

(58) Field of Classification Search
None
See application file for complete search history.

(56) References Cited

U.S. PATENT DOCUMENTS

| | | | |
|---|---|---|---|
| 6,069,115 A | 5/2000 | Pallett et al. | |
| 6,087,563 A | 7/2000 | DellaPenna et al. | |
| 6,118,050 A | 9/2000 | Sturner et al. | |
| 6,245,968 B1 * | 6/2001 | Boudec et al. | 800/278 |
| 6,268,549 B1 | 7/2001 | Sailland et al. | |
| 6,768,044 B1 * | 7/2004 | Boudec et al. | 800/300 |
| 6,791,014 B2 | 9/2004 | Garcon et al. | |
| 7,297,541 B2 | 11/2007 | Moshiri et al. | |
| 7,304,209 B2 | 12/2007 | Zink et al. | |
| 7,312,379 B2 | 12/2007 | Andrews et al. | |
| 8,053,641 B2 * | 11/2011 | Andrews et al. | 800/300 |
| 2005/0246800 A1 | 11/2005 | Dunne et al. | |
| 2011/0039706 A1 * | 2/2011 | Busch et al. | 504/348 |

FOREIGN PATENT DOCUMENTS

| | | |
|---|---|---|
| EP | 1032267 B1 | 9/2000 |
| WO | WO 97/47756 A1 | 12/1997 |
| WO | WO 00/32757 A2 | 6/2000 |
| WO | WO 02/46387 A2 | 6/2002 |
| WO | WO 2005-013696 A1 | 2/2005 |
| WO | WO 2009/144079 A1 | 12/2009 |
| WO | WO 2010/085705 A2 | 7/2010 |

OTHER PUBLICATIONS

Yang et al, Structural basis for herbicidal selectivity revealed by comparison of crystal structures of plant and mammalian 4-hydroxyphenylpyruvate dioxygenases, Biochemistry (2004) 43:10414-10423.*
Lee et al., Functional Characterization of Sequence Motifs in the Transit Peptide of Arabidopsis Small Subunit of Rubisco, Plant Physiol. (2006) 140:466-483.*
Kindle et al, Transit Peptide Mutations That Impair In vitro and in vivo Chloroplast Protein Import Do Not Affect Accumulation of the Gamma-Subunit of Chloroplast ATPase, Plant Physiol (1998) 116:1179-1190.*
Chotewutmontri et al, Differential Transit Peptide Recognition During Preprotein Binding and Translocation into Flowering Plant Plastids, Plant Cell (2012) 24:3040-3059.*
U.S. Appl. No. 13/208,960, filed Aug. 12, 2011, Albert, et al.
U.S. Appl. No. 13/209,017, filed Aug. 12, 2011, Albert, et al.
Dufourmantel,N., et al., "Generation and characterization of soybean and marker-free tobacco plastid transformants over-expressing a bacterial 4-hydroxyphenylpyruvate dioxygenase which provides strong herbicide tolerance," *Plant Biotechnology Journal*, 2007, 118-133(5).

(Continued)

*Primary Examiner* — David H Kruse
*Assistant Examiner* — Mykola Kovalenko
(74) *Attorney, Agent, or Firm* — Ballard Spahr LLP

(57) ABSTRACT

Compositions and methods comprising polynucleotides and polypeptides having 4-hydroxyphenylpyruvate dioxygenase (HPPD) activity and having insensitivity to an HPPD inhibitor are provided. Further provided are nucleic acid constructs, plants, plant cells, explants, seeds and grain having the HPPD sequences. Various methods of employing the HPPD sequences are provided. Such methods include, for example, methods for producing an HPPD inhibitor tolerant plant, plant cell, explant or seed and methods of controlling weeds in a field containing a crop employing the plants and/or seeds disclosed herein. Methods are also provided to identify additional HPPD variants. Further provided are various methods and compositions that allow the various HPPD polypeptides and variant and fragments thereof to be expressed in a chloroplast or transported to a chloroplast.

43 Claims, 29 Drawing Sheets

(56) References Cited

OTHER PUBLICATIONS

Matringe, M., et al., "*p*-Hydroxyphenylpyruvate dioxygenase inhibitor-resistant plants," *Pest Management Science*, 2005, 269-276(61).

Lee. R., et al., "Leaf senescence in rice plants: cloning and characterization of senescence up-regulated genes," *Journal of Experimental Botany*, 2001, vol. 52(358), pp. 1117-1121.

Kiran, K., et al., "The TATA-Box Sequence in the Basal Promoter Contributes to Determining Light-Dependent Gene Expression in Plants," *Plant Physiology*, 2006, vol. 142(1), pp. 364-376.

Lodhi, N. et al., "Interactions between upstream and core promoter sequences determine gene expression and nucleosome positioning in tobacco *PR-la* promoter," *Biochimica et Biophysica Acta*, 2008, vol. 1779(10), pp. 634-644.

Rushton, P., et al., "Synthetic Plant Promoters Containing Defined Regulatory Elements Provide Novel Insights into Pathogen—and Wound-Induced Signaling," *The Plant Cell*, 2002, vol. 14(4), pp. 749-762.

Castle, L., et al, "Discovery and Directed Evolution of a Glyphosate Tolerance Gene," *Science*, 2004, vol. 34(5674), pp. 1151-1154.

Database EMBL—Accession No. AF251071, "Oryza sativa seed protein B32E mRNA, partial cds," 2002, pp. 1-2.

Database EMBL—Accession No. AAA29168, "Soybean 4-hydroxyphenylpyruvate dioxygenase cDNA," 2000, 1 page.

Garcia, I., et al., "Characterization and Subcellular Compartmentation of Recombinant 4-Hydroxyphenylpyruvate Dioxygenase from Arabidopsis in Transgenic Tobacco," *Plant Physiology*, 1999, vol. 119, pp. 1507-1516.

\* cited by examiner

A.
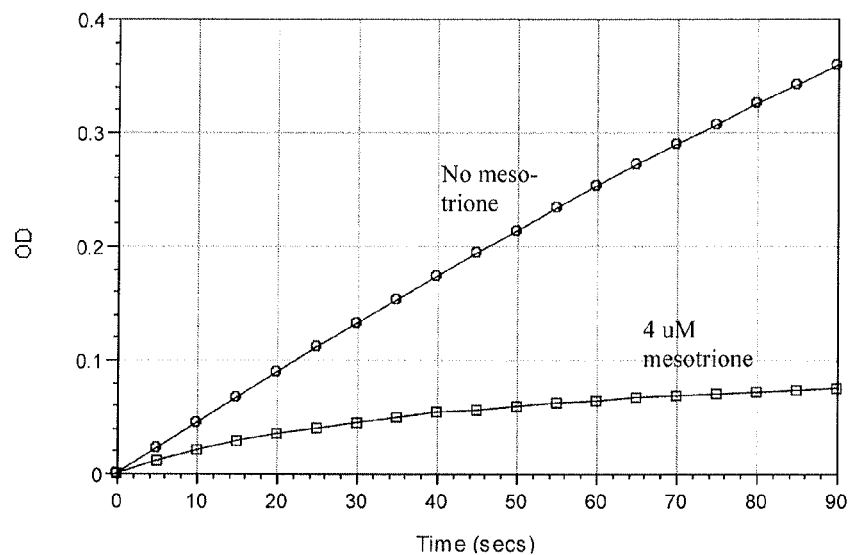
B.
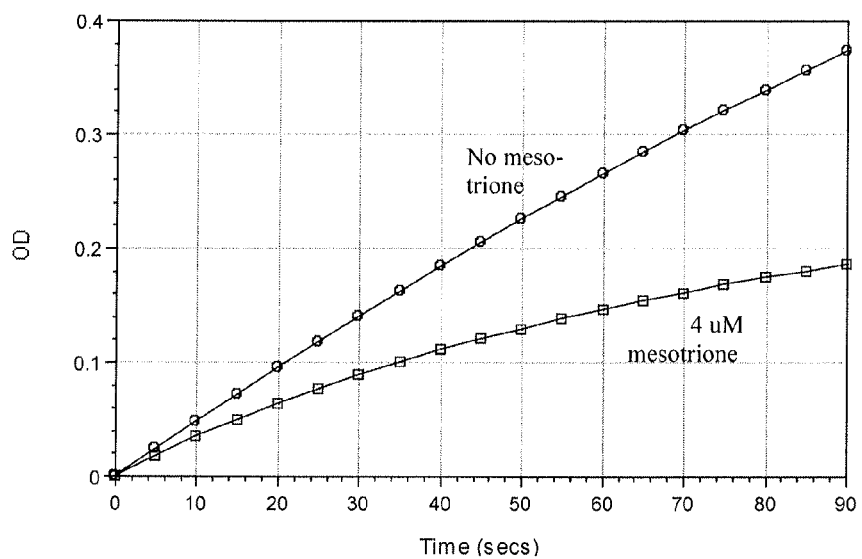
Figure 2

A.
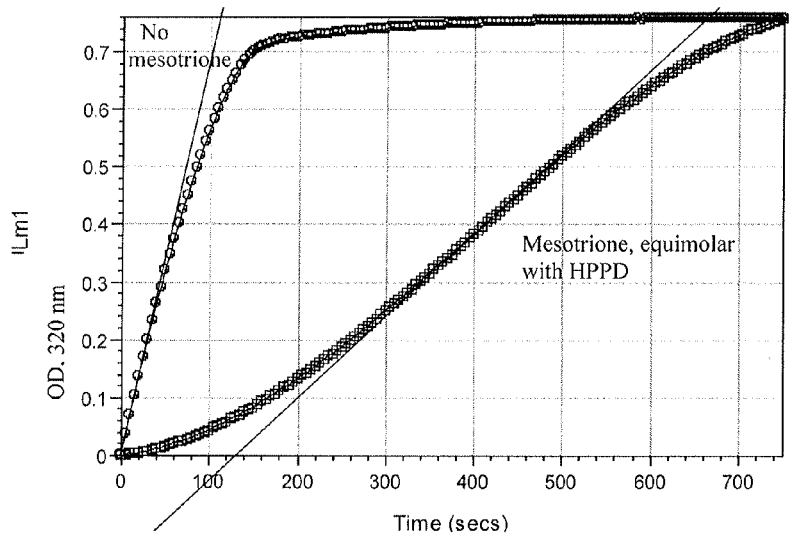
B.
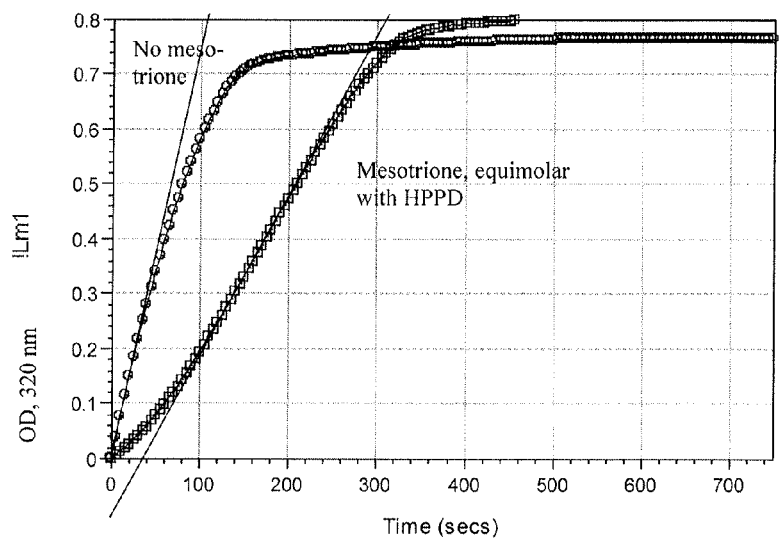
Figure 3

Figure 4

| | | 50 |
|---|---|---|
| Zea mays WO199704816Seq#11 | (1) | ------------------------MPPTPTAAAAGAAVAAASAAEQA |
| Daucus carota O23920 | (1) | ----------------------------MGKKQSAEILSSNSNTSPA |
| S. scutellarioides Q9ARF9 | (1) | ------------------------------MGQESTAAAAVVPA |
| Picea sitchensis EF087545 | (1) | ---------------------------------------------- |
| Abutilon theophrasti AAN28922 | (1) | ---------------------------------------------- |
| Arabidopsis thaliana AAM96960 | (1) | MCLSLASTAQRNTKFRSRVLVLAELVKSMGHQNAAVSENQNHDDGAASSP |
| Brassica rapa ABI63586 | (1) | ------------------MGHENAAVSENQHDDAATTSASP |
| Coptis japonica BAF74636 | (1) | ------------------------------------MVPSTAS |
| Vitis vinifera CAN71143 | (1) | ---------------------------------MGKQNTTTNNPAP |
| Glycine max ABQ96868 | (1) | -----------------------------MCNEIQAQAQAQAQP |
| Medicago truncatula AAX59006 | (1) | ----------------------------------MAIETETQTQTQT |

| | | 100 |
|---|---|---|
| | 51 | |
| Zea mays WO199704816Seq#11 | (24) | AFRLVGHRNFVRFNPRSDRFHTLAFHHVELWCADAASAAGRFSFGLGAPL |
| Daucus carota O23920 | (22) | TFKLVGFNNFVRANPKSDHFPAVKRFHHIBFWCGDAINTSRRFSWGLGMPL |
| S. scutellarioides Q9ARF9 | (15) | EFKLVGHKNFVRSNPMSDHFPVHRFHHVEBFWCGDAINTSRRFSWGLGMPL |
| Picea sitchensis EF087545 | (1) | ---------------------------------------------- |
| Abutilon theophrasti AAN28922 | (1) | ---------------------------CTDAINAACRFSWGLGMQF |
| Arabidopsis thaliana AAM96960 | (51) | GFKLVGFSKFVRKNPKSDKFKVKRFHHIEFWCGDAINVARRFSWGLGMRF |
| Brassica rapa ABI63586 | (25) | GFKLVGFSKFVRKNPKSDKFKVKRFHHIEFWCGDAINVARRFSWGLGMRF |
| Coptis japonica BAF74636 | (8) | NLKLVGHTNFVHNNPKSDKFHVKKFHHIEFWSTDAINTARRFSWGLGMPM |
| Vitis vinifera CAN71143 | (14) | GFKLVGFSNFLRTNPMSDRFGVKRFHHIEFWSTDAINLARRFSWGLGMPI |
| Glycine max ABQ96868 | (22) | GFKLVGFKNFVRTNPEKSDRFQVNRFHHIEFWCTDAINASRRFSWGLGMPI |
| Medicago truncatula AAX59006 | (14) | GFKLVGFKNFVRANPKSDRFNVKRFHHVEFWCTDAINTARRFSHGLGMPI |

| | | 150 |
|---|---|---|
| | 101 | |
| Zea mays WO199704816Seq#11 | (74) | AARSDLSTGNSAHASILLRSGSLSFLFTAPYAHGADAAT------AALP |
| Daucus carota O23920 | (72) | VAKSDLSTGNSVHASYLIVRSANLSFVTTAPYSPSTTTSSGS----AAIP |
| S. scutellarioides Q9ARF9 | (65) | VAKSDLSTGNSAHASYLLRSGELSFVETAPYSPSLAEPS-S----ASIP |
| Picea sitchensis EF087545 | (1) | ---------------------------------------------- |
| Abutilon theophrasti AAN28922 | (20) | VAKSDLSTGNLSHASYLIRSDHLSLLFTAPYSPSIALSQNISPHSTASIP |
| Arabidopsis thaliana AAM96960 | (101) | SAKSDLSTGNMVHASYLLTSGDLRFLFTAPYSPSLSAGEIKP-TTTASIP |
| Brassica rapa ABI63586 | (75) | SAKSDLSTGNMVHASYLLTSGDERFLFTAPYSPSLSAGENPP-TTTASIP |
| Coptis japonica BAF74636 | (58) | VAKSDLSTGNMVHASYLLRSGELNFLFTAPYSPSIAGNTLT--HTASIP |
| Vitis vinifera CAN71143 | (64) | VAKSDLSTGNVIHASYLTRSGDLNELFTAPYSPSIAGDLEN-AAATASIP |
| Glycine max ABQ96868 | (72) | VAKSDLSTGNQIHASYLLRSGDLSFLFSAPYSPSLSAGSSAAS--SASIP |
| Medicago truncatula AAX59006 | (64) | VAKSDLSTGNLTHASYLLRSGDLNFLFSAAYSPSISLSSPS---STAAIP |

Figure 5A

```
                                        151                                                          200
Zea mays WO1997049816Seq#11      (117)  SFSAAAARFAADHGLAVRAVALRVADAEDAFRASVAAGARPAFGPVDLG
         Daucus carota O23920    (117)  SFSASGFHSFAAKHGLAVRAIALRVADVAAFEASVARGARPASAPVELD
     S. scutellarioides Q9ARF9   (109)  TFSFSDHRAFTSSHGLAVRAVAIQVDSASSAYSAAVSRGAKPVSPPVLA
         Picea sitchensis EF087545  (1)  ----------------------------------------------
     Abutilon theophrasti AAN28922  (70)  SFDHTLCRSFSSSHGLVVRAIALEVEDSETAFATSISNGALPSSPPILID
     Arabidopsis thaliana AAM96960 (150)  SFDHGSCRSFFSSHGLGVRAVAIEVEDAESAFSISVANGAIPSSPPIVLN
            Brassica rapa ABI63586 (124)  SFDHVTYRSFFSSHGLGVRAVAVEVEDAEAAFSISVSNGAVPSSPPIVLN
         Coptis japonica BAF74636 (105)  TYSHNLARLFASTHGLAVRAIATEVQDAELAYNISVANGAKPSSSPIKLD
           Vitis vinifera CAN71143 (113)  SPDHSACHAFAASHGLGVRAIAIEVDDAEGAFHTSVAHGARPMSPPVIMG
             Glycine max ABQ96868 (120)  SFDAATCLAFAAKHGFGVRAIALEVADAARPSASVAKGAEPASPPVLVD
       Medicago truncatula AAX59006 (111)  TFSASTCFSFSASHGLAVRAVAVEVEDAEVAFTTSVNLGAIPSSPPVLLR
                                        201                                                          250
Zea mays WO1997049816Seq#11      (167)  RGF-RLAEVELYGDVVLRYVSYPDGAAGE-------PFLPGFEGVASPGA
         Daucus carota O23920    (167)  DQA-WLAEVELYGDVVLRFVSFGREEG--------LFLPGFEAVEGTAS
     S. scutellarioides Q9ARF9   (159)  DCETAIAEVHLYGDTVLRFVSCGSGADG-------WFLPGFEVVGDGVS
         Picea sitchensis EF087545  (1)  --MSEVKLYGDVVLRFVSKDGFEG---------PFLPNYEPVQSIPL
     Abutilon theophrasti AAN28922 (120)  GAT--ISEVKLYGDVVLRYVSYSKNTN----P---HHFLPGFEKVEDNLS
     Arabidopsis thaliana AAM96960 (200)  EAV--TIAEVKLYGDVVLRYVSYKAEDTEKS------EFLPGFERVEDASS
            Brassica rapa ABI63586 (174)  DAV--TIAEVKLYGDVVLRYVSYKVATV---------FLPRFETVDDTSS
         Coptis japonica BAF74636 (155)  EGV-VLSEIQLYGDVVLRYLSFKNTNQS-------CPFLPGFEEVGEVSS
           Vitis vinifera CAN71143 (163)  GSV-VISEVHLYGDAVLRYVSYKNPNPNATSDP-SSWFLPGFEAVDEGSS
             Glycine max ABQ96868 (170)  DRT-GFAEVRLYGDVVLRYVSYKDAAPQAPHADPSRWFLPGFEAAASSS
       Medicago truncatula AAX59006 (161)  NNV-KLAEVHLYGDVVLRYVSYNDLNPNQNPN--LFFLPGFFRVSDESS
                                        251                                                          300
Zea mays WO1997049816Seq#11      (209)  AD---YGLSRFDHIVGNVPELAPAAAYFAGFTGFHEFAEFTTEDVGTAES
         Daucus carota O23920    (207)  FPDLDYGIRRLDHAVGNVTELGPVVEYIKGFTGFHEFAEFTAEDVGTLES
     S. scutellarioides Q9ARF9   (201)  CQELDYGIRRLDHAVGNVPKLEPVVDYLKKFTGFHEFAEFTAEDVGTAES
         Picea sitchensis EF087545 (37)  S---YGIIRVDHAVGNVEKLEEAVEYVAKFTGFHRFAEFTAEDVGTAES
     Abutilon theophrasti AAN28922 (161)  YP--LDYGIRRLDHAVCCVPELGPAISVVKSFTGFHDLAEFTAEDVGTSES
     Arabidopsis thaliana AAM96960 (243)  FP--LDYGIRRLDHAVGNVPELGPALTYVAGFTGFHQFAEFTANDVGTAES
            Brassica rapa ABI63586 (213)  FP--LDYGIRRLDHAVGNVPELGPALTYLSRLTGFHQFAEFTADDVGTAES
         Coptis japonica BAF74636 (197)  SRGLDFGIRRLDHAVGNVPNLAEAIGYLKEFTGFHEFAEFTAEDVGTTES
           Vitis vinifera CAN71143 (211)  FP-VDFGLRRVDHTVGNVPKLAPVVTYLKQFTGFHEFAEFTAEDVGTSES
             Glycine max ABQ96868 (219)  FPELDYGIRRLDHAVGNVPELAPAVRYLKGFGFHEFAEFTAEDVGTSES
       Medicago truncatula AAX59006 (207)  NSSLDFGIRRLDHAVGNVPELSSAVKYVKQFTGFHEFAEFTAEDVGTSES
```

```
                                         451                                                 489
Zea mays WO199704981C6Seq#11      (406)   GGCGGGFGKGNFSQLFKSIEDYEKSLEAKQAAAAAAAQGS
     Daucus carota O23920         (407)   GGCGGGFGKGNFSELFKSIEEYEKTLEAKQITGSAAA---
  S. scutellarioides Q9ARF9       (401)   GGCGGGFGKGNFSELFKSIEEYEKMLESKLVTKTAMA---
     Picea sitchensis EF087545    (233)   GGCGGGFGKGNFSELFKSIEEYEKTLEGRVQS--------
    Abutilon theophrasti AAN28922 (360)   GGCG------------------------------------
  Arabidopsis thaliana AAM96960   (442)   GGCGGGFGKGNFSELFKSIEEYEKTLEAKQLVG-------
         Brassica rapa ABI63586   (412)   GGCGGGFGKGNFSELFKSIEEYEKTLEAKQLVG-------
     Coptis japonica BAF74636     (397)   AGCGGGFGKGNFSELFKSIEEYEKTLEAKANVVAA-----
        Vitis vinifera CAN71143   (410)   GGCGGGFGKGNFSELFKSIEEYEKTLGAKRIVDPAPV---
           Glycine max ABQ96868   (419)   GACGGGFGKGNFSELFKSIEEYEKTLEAKRTA-GLT-VNS
    Medicago truncatula AAX59006  (407)   GGCGGGFGKGNFSELFKSIEEYEKTLETRRTA--------
```

Figure 5D

```
                                            1                                                        50
Zea mays WO199704 9816Seq#11           (1)  MPPTPTAAAAGAAV-AAASAAEQAAFRLVGHRNFVRFNPRSDRFHTLAPH
Oryza sativa BAD26248.1                (1)  MPPTPTPTATTGAVSAAAAAGENAGFRLVGHRRFVRANPRSDRFQALAFH
Avena sativa WO0246387                 (1)  MPPTP-ATAT-GA--AAAAVTPEHAAR--SFPRVRVNPRSDRFPVLSFH
Hordeum vulgare O48604                 (1)  MPPTPTTPAATG---AAAAVTPEHA-RP--HR-MVRFNPRSDRFHTLSFH
Triticum aestivum AAZ67144             (1)  MPPTPTTPAATGAG-AAAAVTPEHA-RP---RRMVRFNPRSDRFHTLSFH
Acinetobacter sp 294841163             (1)  --------------------------------------------------
Pseudomonas syringae NP_793333         (1)  --------------------------------------------------
Legionella pneumophila 60392610        (1)  --------------------------------------------------
Ralstonia solanacearum 299078043       (1)  --------------------------------------------------
Bacillus thuringiensis YP_893139       (1)  --------------------------------------------------
Chloroflexus aurantiacus YP_001634433  (1)  ---------------------------------MVLSMNHLIYLQGDEDFMKQ
Catenulispora acidiphila YP_003112250  (1)  ---------------------------------------------MTETA
Micromonospora aurantiaca ZP06217482   (1)  ------------------------------------MTQAIDRPQSTEVDVDAL
Salinispora tropica YP_001161056       (1)  ------------------------------------MTQAIDRPQTSDEVDADL
Geodermatophilus obscures YP_003409000 (1)  ---------------------------MSLEQALNDDERLAQLDLDQLKQ
Kribbella flavida YP_003379684         (1)  ---------------------------MTSTDLTPAELDADLDLDQLKQ
Streptomyces aver AAA50231             (1)  ------------------------------------------MTQTTHH
Ostreococcus tauri CAL53021            (1)  -----------------MTTSASGRKLVGHANFVRCNPLSDAFECVGFD
Daucus carota O23920                   (1)  ------------MGKKQSEAEILSSNSSNTSPATFKLVGFNNFVRANPKSDHFA
Solenostemon scutellarioides Q9ARF9    (1)  ------------MGQESTAAAAVVPAEFKLVGFSKFVRKNPSDKFKVKRFH
Brassica rapa ABI63586                 (1)  MGHENAAVSENQHHDDAATTSASPGFKLVGHTNFVHNNPKSDKFHVKKFH
Coptis japonica BAF74636               (1)  --------------------MVPSTASNLKLVGHTNFVHNNPKSDKFHVKKFH
Glycine max ABQ96868                   (1)  ---------------MCNEIQAQAQAQAQPGFKLVGFKNFVRTNPKSDRFQVNRFH
Vitis vinifera CAN71143                (1)  --------------------MGKQ-NTTTNNPAPGFKLVGFSNFLRTNPMSDRFGVKRFH
Medicago truncatula AAX59006           (1)  --------------------MAIETETQTQTQTGFKLVGFKNFVRANPKSDRFNVKRFH
Homo sapiens 417144                    (1)  -------------------------------------------------M
Rattus norvegicus P32755               (1)  -------------------------------------------------M
Mus musculus 33859486                  (1)  -------------------------------------------------M
Bos taurus 75057880                    (1)  -------------------------------------------------M
```

Figure 8A

```
                                               51                                                   100
       Zea mays WO199704981Seq#11  (50) HVELWCADAASAAGRFSFGLGAPLAARSDLSTGNSAHASLLLRSGSLSFL
         Oryza sativa BAD26248.1   (51) HVELWCADAASAAGRFAFALGAPLAARSDLSTGNSAHASLLLRSASVAPL
           Avena sativa WO0246387  (45) HVELWCADAASAAGRFSFALGAPLAARSDLSTGNSAHASLLLRSGALAFL
         Hordeum vulgare O48604    (44) HVEFWCADAASAAGRFAFALGAPLAARSDLSTGNSAHASQLLRSGLAFL
        Triticum aestivum AAZ67144 (46) HVEFWCADAASAAGRFAFALGAPLAARSDLSTGNSVHASQLLRSGNLAFL
           Acinetobacter sp 294841163 (1) ----------MDILENPLELCGFAFIEFVSKE-NELDPIFETIGF
       Pseudomonas syringae NP_793333 (1) ----------MADLYEADKYENPMGLMGFEFIEFASPTPNSLRPVFQMMGF
      Legionella pneumophila 60392610 (1) ----------MQNNNPCGLDGFAFLEFSGPDRNKLHQQFSEMGF
      Ralstonia solanacearum 299078043 (1) --------------MSAVTTAGFAFVEFVCAEPNELVALFG
      Bacillus thuringiensis YP_893139 (21) KSMDTLAAQMEDFFPVRDVDHLEFYVGNAKQSSYYLARAFGFKIVAYSGL
    Chloroflexus aurantiacus YP_001634433 (1) ------MCSADPLELLGIDYVEFYVSNARQAAHFYRTTLGLRPVAYAGL
     Catenulispora acidphila YP_003112250 (6) TASAASATATKDPFPVKGMDAVVFAVGNAKQAAHYYSTAFGMRVVAYSGP
     Micromonospora aurantiaca ZP062217482 (20) VGAVDHDITRDPFPVKGMDHVHFLVGNAKQAAHYYSTAFGMTCVAYRGPE
         Salinispora tropica YP_001161056 (19) LVGAVDHDISHDPFPVKGLDHVQFLVGNAKQAAHYYSTAFGMTCVAYRGP
     Geodermatophilus obscures YP_003409000 (24) LVGLVEYDASGDPFPVSGWDALVWVVGNATQAAHFHQSAFGMELVAYSGP
         Kribbella flavida YP_003379684 (23) LVGLVPYDESTDPFPVTAMDAVVFVVGNATQTAKFYQLAFGMDLVAYAGP
        Streptomyces aver AAA50231 (8) TPDTARQADPFPVKGMDAVVFAVGNAKQAAHYSTAFGMQLVAYSGPENGS
       Ostreococcus tauri CAL53021 (33) HVEFWCGDATNAASRFGVGLGMSLRAKSDASTGNGIYASYAMKSHDLTFV
          Daucus carota O23920     (43) VKRFHHIEFWCGDATNTSRRFSWGLGMPLVAKSDLSTGNSVHASYLVRSA
   Ostenostemon scutellarioides Q9ARF9 (35) PVHRFHHVEFWCGDATNTSRRFSWGLGMRFSAKSDLSTGNSAHASYLLRS
           Brassica rapa ABI63586  (51) HIEFWCGDATNVARRFSWGLGMRFSAKSDLSTGNMVHASYLLTSGDLRFL
          Coptis japonica BAF74636 (34) HIEFWSTDATNTARRFSWGLGMPMVAKSDLSTGNMVHASYLLRSGELNFL
           Glycine max ABQ96868    (48) HIEFWCTDATNASRRFSWGLGMPIVAKSDLSTGNQIHASYLLRSGDLSFL
          Vitis vinifera CAN71143  (40) HIEFWSTDATNLARRFSWGLGMPIVAKSDLSTGNVIHASYLLTRSGDINFL
        Medicago truncatula AAX59006 (40) HVEFWCTDATNTARRFSHGLGMPIVAKSDLSTGNLTHASYLLRSGDINFL
           Homo sapiens 417144     (2) TTYSDKGAKPERGRFLHFHSVTFWVGNAKQAASFYCSKMGFEPLAYRGLE
        Rattus norvegicus P32755   (2) TTYSNKGPKPERGRFLHFHSVTFWVGNAKQAASFYCNKMGFEPLAYKGLE
          Mus musculus 33859486    (2) TTYNNKGPKPERGRFLHFHSVTFWVGNAKQAASFYCNKMGFEPLAYRGLE
           Bos taurus 75057880     (2) TTYSDKGEKPERGRFLHFHSVTFWVGNAKQAASYYCSKLGFEPLAYKGLE
```

Figure 8B

```
                                       101                                                              150
              Zea mays WO199704981Seq#11 (100) FTAPYA------HGADAATAALPSFSAAAARRFAADHGLAVRAVALRVA
                Oryza sativa BAD26248.1 (101) FTAPYGGDH-G-VGADAATTASIPSFSPGAARRFAADHGLAVHAVALRVA
                Avena sativa WO0246387  (95) FTAPYAPPP-Q-EAATAAATASIPSFSADAARTFAAAHGLAVRSVGVRVA
                Hordeum vulgare O48604  (94) FTAPYA------NGCDAATASLPSFSADAARRFSADHGIAVRSVALRVA
             Triticum aestivum AAZ67144 (96) FTAPYA------NGCDAATASLPSFSADAARRFSADHGLAVRSIALRVA
              Acinetobacter sp 294841163 (35) SKVAKHKSKKAYLWRQGNINIILNYQPESYASFFNEHGPSACAMGFKTR
          Pseudomonas syringae NP_793333 (42) TKVATHRSKDVTLYRQGAINLILNNEPHSLASYFAAEHGPSVCGMAFRVK
          Legionella pneumophila 60392610 (35) QAVAHHKNQDITLFKQGEIQFIVNAASHCQAEAHASTHGPGACAMGFKVK
         Ralstonia solanacearum 299078043 (28) KLGFKALGQHAQTGAVLLRQNEAVLIVNPAPNPFRDVHGASARAIAINVD
      Bacillus thuringiensis YP_893139 (71) ETGNREKVSYVLVQKNMRFVVSGALSSDNRIAEFVKTHGDGVKDVALLVD
   Chloroflexus aurantiacus YP_001634433 (44) ETGVRDRASYVLERRNVRFVLTAPLLPDHPIAQHIAHHGDGVKDIALRVR
     Catenulispora acidphila YP_003112250 (56) ETGRADRVAYVLESGSSARFVFKGSVRPGTEIALHVAEHGDGVTDLAIAVP
   Micromonospora aurantiaca ZP06217482 (70) QGYRDHAQYVLTSGSARFVLTGAVRPDADGAEHVAK-HSDGVSDIALEVP
      Salinispora tropica YP_001161056 (69) EQGYRDHAQYVLTSGSARFVLTGAVRPDAAGAEQVARHSDGVCDIALEVP
   Geodermatophilus obscures YP_003409000 (74) ETGNRDHLAYVLESGAARFVVRGAYDPASPLADHIRKHGDGIVDIALSVP
        Kribbella flavida YP_003379684  (73) ETGSKDAKYFVLKAGSARFVLTSVIKPATPWGHFLADHVAEHGDGVVDLALEVP
             Streptomyces aver AAA50231 (58) RETASYVLTNGSARFVLTSVIKPATPWGHFLADHVAEHGDGVVDLAIEVP
           Ostreococcus tauri CAL53021  (83) FTAPYGDDERAVGCGGSSVNVPHPGNERGAMMRFFERHGLAARAVGLRVG
             Daucus carota O23920       (93) NLSFVFTAPYSPSTTTSSGSAAIPSFSASGFHSFAAKHGLAVRAIALEVA
Solenostemon scutellarioides Q9ARF9     (85) GELSFVFTAPYSPSPSLAEPSSASIPTFSFSDHRAFTSSHGLAVRAVAIQVD
            Brassica rapa ABI63586      (101) FTAPYSPSL-SAGENPPTTTASIPSFDHVTYRSFFSSHGLGVRAVAVEVE
          Coptis japonica BAF74636      (84) FTAPYSP-S-I-AGNTLTHTASIPTYSHNLARLFASTHGLAVRAIAIEVQ
            Glycine max ABQ96868        (98) FSAPYSPSL-S-AGSSAASSASIPSFDAATCLARAAKHGFGVRAIALEVA
            Vitis vinifera CAN71143     (90) FTAPYSPSI-AGDLENAAATASIPSFDHSACHAFAASHGLGVRAIAIEVD
         Medicago truncatula AAX59006   (90) FSAAYSP-S-I-SLSSPSSTAAIPTFSASTCFSRSASHGLAVRAVAVEVE
              Homo sapiens 417144       (52) TGSREVVSHVIKQGKIVFVLSSALNPWNKEMGDHLVKHGDGVKDIAFEVE
          Rattus norvegicus P32755      (52) TGSREVVSHVIKQGKIVFVLCSALNPWNKEMGDHLVKHGDGVKDIAFEVE
              Mus musculus 33859486     (52) TGSREVVSHVIKQGKIVFVLCSALNPWNKEMGDHLVKHGDGVKDIAFEVE
              Bos taurus 75057880       (52) TGSREVVSHVVKQGQIVFVFSSALNPWNKEMGDHLVKHGDGVKDIAFEVE
```

Figure 8C

```
                                              151       160
        Zea mays WO199704981G Seq#11   (143) DAEDAFRASV
         Oryza sativa BAD26248.1       (149) DAADAFRASV
          Avena sativa WO0246387       (143) DAAEAFRVSV
        Hordeum vulgare O48604         (137) DAAEAFRASR
       Triticum aestivum AAZ67144      (139) DAAEAFRASV
          Acinetobacter sp 294841163   (85)  DAAKAFKKAV
        Pseudomonas syringae NP_793333 (92)  DAQHAYNRAL
       Legionella pneumophila 60392610 (85)  DAKAAFQHAI
    Ralstonia solanacearum 299078043   (78)  NAANALAQAL
    Bacillus thuringiensis YP_893139   (121) DVDKAYSEAV
 Chloroflexus aurantiacus YP_001634433 (94)  DAVTAYETAV
   Catenulispora acidphila YP_003112250 (106) DVYAAYFYAV
   Micromonospora aurantiaca ZP06217482 (119) DVDAAYAHAV
       Salinispora tropica YP_001161056 (119) DVDAAHAHAI
   Geodermatophilus obscures YP_003409000 (124) DVDRCIAHAA
         Kribbella flavida YP_003379684 (123) DVDKCVKHAR
          Streptomyces aver AAA50231   (108) DARAAHAYAI
          Ostreococcus tauri CAL53021  (133) DVAAREEAM
             Daucus carota O23920      (143) DVAAFEASV
Solenostemon scutellarioides Q9ARF9    (135) SASSAYSAAV
           Brassica rapa ABI63586      (150) DAEAAFSISV
         Coptis japonica BAF74636      (131) DAELAYNISV
            Glycine max ABQ96868       (146) DAEAAFSASV
         Vitis vinifera CAN71143       (139) DAEGAFHTSV
        Medicago truncatula AAX59006   (137) DAEVAFTTSV
             Homo sapiens 417144       (102) DCDYIVQKAR
        Rattus norvegicus P32755       (102) DCEHIVQKAR
             Mus musculus 33859486     (102) DCDHIVQKAR
              Bos taurus 75057880      (102) DCDYIVQKAR
```

Figure 8D

Designed *Sorghum bicolor* and *Glycine max* HPPD proteins based on motifs unique to improved maize HPPD sequences

| | | |
|---|---|---|
| | | 1 ... 75 |
| Sorghum bicolor HPPD designed | (1) | MPPTPTTAAATGAAVAAASAEQAAFRLVGHRNFVRVNPRSDRFHTLAFHHVELWCADAASAAGRFSFGLGAPLAA |
| Sorghum bicolor XP_002453359 | (1) | MPPTPTTAAATGAAVAAASAEQAAFRLVGHRNFVRVNPRSDRFHTLAFHHVELWCADAASAAGRFSFGLGAPLAA |
| | | 76 ... 150 |
| Sorghum bicolor HPPD designed | (76) | RSDLSTGNTAHASLLLRSGALAFLFTAPYAHGADAATASLPSFSAAEARRFAADHGLAVRAVALRVADAEDAFRA |
| Sorghum bicolor XP_002453359 | (76) | RSDLSTGNTAHASLLLRSGALAFLFTAPYAHGADAATASLPSFSAAEARRFAADHGLAVRAVALRVADAEDAFRA |
| | | 151 ... 225 |
| Sorghum bicolor HPPD designed | (151) | SVAAGARPAFEPVELGLGFRLAEVELYGDVVLRYVSYPDDADASFLPGFVGVASPGAVDYGLRRFDHIVVNVPEL |
| Sorghum bicolor XP_002453359 | (151) | SVAAGARPAFEPVELGLGFRLAEVELYGDVVLRYVSYPDDADASFLPGFVGVTSPGAADYGLRRFDHIVGNVPEL |
| | | 226 ... 300 |
| Sorghum bicolor HPPD designed | (226) | APAAAYLAGFTGFHEFAEFTAEDVGTTESGLNSMALANNAENVLLPLNEPVHGTKRRSQIQTYLDHHGGPGVQHI |
| Sorghum bicolor XP_002453359 | (226) | APAAAYFAGFTGFHEFAEFTAEDVGTTESGLNSMVLANNAENVLLPLNEPVHGTKRRSQIQTYLDHHGGPGVQHM |
| | | 301 ... 375 |
| Sorghum bicolor HPPD designed | (301) | AVASDDVLRTLREMQARSAMGGFEFMPPPPSEYYDGVRRCAGDVLTEAQIKECQELGVMVDRDDQGVLLQIFTKP |
| Sorghum bicolor XP_002453359 | (301) | ALASDDVLRTLREMQARSAMGGFEFMAPPAPEYYDGVRRRAGDVLTEAQIKECQELGVLVDRDDQGVLLQIFTKP |
| | | 376 ... 440 |
| Sorghum bicolor HPPD designed | (376) | VGDRPTLFLEIIQRIGCMEKDEKGQEYQKGGCGGFGKGNFGQLFKSIEDYEKSLEAKQAAAAQGS |
| Sorghum bicolor XP_002453359 | (376) | VGDRPTLFLEIIQRIGCMEKDEKGQEYQKGGCGGFGKGNFSQLFKSIEDYEKSLEAKQAAAAQGS |

Figure 9A

Designed *Sorghum bicolor* and *Glycine max* HPPD proteins based on motifs unique to improved maize HPPD sequences Glycine max designed HPPD (1) MCNEIQAQAQAQAQPGFKLVGFKNFVRTNPKSDRFQVNRFHHIEFWCTDATNASRRFSWGLGMPIVAKSDLSTGN
Glycine max ABQ96868 HPPD (1) MCNEIQAQAQAQAQPGFKLVGFKNFVRTNPKSDRFQVNRFHHIEFWCTDATNASRRFSWGLGMPIVAKSDLSTGN 76 150

Glycine max designed HPPD (76) QIHASYLLRSGDLSFLFSAPYSPSLSAGSSAASSASIPSFDAATCLAFAAKHGFGVRAIALEVADAEAAFSASVA
Glycine max ABQ96868 HPPD (76) QIHASYLLRSGDLSFLFSAPYSPSLSAGSSAASSASIPSFDAATCLAFAAKHGFGVRAIALEVADAEAAFSASVA 151 225

Glycine max designed HPPD (151) KGAEPASPPVLVDDRTGFAEVRLYGDVVLRYVSYKDAAPQAPHADPSRWFLPGFEAAASSSSFPEVDYGIRRLDH
Glycine max ABQ96868 HPPD (151) KGAEPASPPVLVDDRTGFAEVRLYGDVVLRYVSYKDAAPQAPHADPSRWFLPGFEAAASSSSFPELDYGIRRLDH 226 300

Glycine max designed HPPD (226) AVVNVPELAPAVAYLAGFSGFHEFAEFTAEDVGTSESGLNSMALANNSETVLLPLNEPVYGTKRKSQIETYLEHN
Glycine max ABQ96868 HPPD (226) AVGNVPELAPAVRYLKGFSGFHEFAEFTAEDVGTSESGLNSVVLANNSETVLLPLNEPVYGTKRKSQIETYLEHN 301 375

Glycine max designed HPPD (301) EGAGVQHLIAVASDIFTTLREMRKRSFLGGFEFMPPPPPSYYANLRRCAGDVLTVDQIKQCEELGVMVDRDDQGT
Glycine max ABQ96868 HPPD (301) EGAGVQHLALVTHDIFTTLREMRKRSFLGGFEFMPSPPPTYYANLHNRAADVLTVDQIKQCEELGILVDRDDQGT 376 443

Glycine max designed HPPD (376) LLQIFTKPVGDRPTIFIXIIQRIGCMVEDEEGKVYQKGACGGFGKGNFGQLFKSIEEYEKTLEAKRTA
Glycine max ABQ96868 HPPD (376) LLQIFTKPVGDRPTIFIXIIQRIGCMVEDEEGKVYQKGACGGFGKGNFSELFKSIEEYEKTLEAKRTA

Figure 9B

```
                                           1                                                              60
Zea mays WO1997049816Seq#11        (1)  MPPTPTAAAAGAAV-AAASAAEQAAPFRLVGHRNFVRFNPRSDRFHTLAFHHVELWCADAA
Oryza sativa BAD26248.1            (1)  MPPTPTPTATTGAVSAAAAAGENAGFRLVGHRRFVRANPRSDRFQALAFHHVELWCADAA
Avena sativa WO0246387             (1)  MPPTP-ATAT-GA--AAAAVTPEHAAR--SFPRVVRVNPRSDRFPVLSFHHVELWCADAA
Hordeum vulgare O48604             (1)  MPPTPTTPAATG--AAAAVTPEHA-RP--HR-MVRFNPRSDRFHTLSFHHVEFWCADAA
Triticum aestivum AAZ67144         (1)  MPPTPTTPAATGAG-AAAAVTPEHA-RP--RRMVRFNPRSDRFHTLSFHHVEFWCADAA
Acinetobacter sp 294841163         (1)  ------------------------------------------------------------
Pseudomonas syringae NP_793333     (1)  -------------------------------------------------------------M
Legionella pneumophila 60392610    (1)  ------------------------------------------------------------
Ralstonia solanacearum 299078043   (1)  ------------------------------------------------------------
Bacillus thuringiensis YP_893139   (1)  --------------------------MVLSMNHLIYLQGDEDFMKQKSMDTLAAQM
Chloroflexus aurantiacus YP_001634433 (1) -----------------------------------------------------MCS
Catenulispora acidphila YP_003112250 (1) ------------------------------------MTETATASAASATAT
Micromonospora aurantiaca ZP06217482 (1) ----------------------MTQAIDRPQSTEEVDVDALVGAVDHDITR
Salinispora tropica YP_001161056   (1)  ----------------------MTQAIDRPQTSDEVDADLLVGAVDHDIS
Geodermatophilus obscurus YP_003409000 (1) ------------------MSLEQALNDDERLAQLDLDQLKQLVGLVEYDAS
Kribbella flavida YP_003379684     (1)  -------------------MTSTDLTPAELDADLDLDQLKQLVGLVPYDES
Streptomyces aver AAA50231         (1)  ------------------------MTQTTHHTPDTARQADP
Ostreococcus tauri CAL53021        (1)  ----------MTTSASGRKLVGHANFVRCNPLSDAFECVGFDHVEFWCGDAT
Daucus carota O23920               (1)  ----------MGKKQSEAEILSSNSSNTSPATFKLVGFNNFVRANPKSDHFAVKRFHHIEFW
Solenostemon scutellarioides Q9ARF9 (1) ----------MGQESTAAAAVVPAEFKLVGHKNFVRSNPMSDHFPVHRFHHVEF
Brassica rapa ABI63586             (1)  MGHENAAVSENQHHDDAATTSASPGFKLVGFSKFVRKNPKSDKFKVKRFHHIEFWCGDAT
Coptis japonica BAF74636           (1)  ------------MVPSTASNLKLVGHTNFVHNNPKSDKFHVKKFHHIEFWSTDAT
Glycine max ABQ96868               (1)  ----MCNEIQAQAQAQAQAQPGFKLVGFKNFVRTNPKSDRFQVNRFHHIEFWCTDAT
Vitis vinifera CAN71143            (1)  ----------MGKQ-NTTTNNPAPGFKLVGFSNFLRITNPMSDRFGVKRFHHIEFWSTDAT
Medicago truncatula AAX59006       (1)  -------MAIETETQTQTQTGFKLVGFKNFVRANPKSDRFNVKRFHHVEFWCTDAT
Homo sapiens 417144                (1)  ------------------------------------------------MTTYSDKGAKP
Rattus norvegicus P32755           (1)  ------------------------------------------------MTTYSNKGPKP
Mus musculus 33859486              (1)  ------------------------------------------------MTTYNNKGPKP
Bos taurus 75057880                (1)  ------------------------------------------------MTTYSDKGEKP
```

Figure 10A

```
                                              61                                                                           120
Zea mays WO1997049816Seq#11      (60) SAAGRFSFGLGAPLAARSDLTGNSAHASLLLRSGSLSFLFTAPYA------HGADAAT
Oryza sativa BAD26248.1          (61) SAAGRFAFALGAPLAARSDLTGNSAHASLLLRSASVAFLFTAPYGGDH-G-VGADAATT
Avena sativa WO0246387           (55) SAAGRFSFALGAPLAARSDLTGNSAHASLLLRSGALAFLFTAPYAPPP-Q-EAATAAAT
Hordeum vulgare O48604           (54) SAAGRFAFALGAPLAARSDLTGNSAHASQLLRSGSLAFLFTAPYA------NGCDAAT
Triticum aestivum AAZ67144       (56) SAAGRFAFALGAPLAARSDLTGNSVHASQLLRSGNLAFLFTAPYA------NGCDAAT
Acinetobacter sp 294841163        (1) ----MDILENPLELCGFAPIEFVSKE-NELDPIFETIGFSKVAKHKSKKAYLWRQGNIN
Pseudomonas syringae NP_793333    (2) ADLYEADKYENPMGLMGFEFIEFASPTPNSLEPVFQMMGFTKVATHRSKDVTLYRQGAIN
Legionella pneumophila 603926l0   (1) ------MQNNNPCGLDGFAFLEFSGPDRNKLHQQFSEMGFQAVAHHKNQDITLFKQGEIQ
Ralstonia solanacearum 299078043  (1) -------MSAVTTAGFAFVEFVCAEPNELVALFGKLGFKALGQHAQTGAVLLRQ
Bacillus thuringiensis YP_893139 (31) EDFFPVRDVDHLEFYVGNAKQSSYYLARAFGFKIVAYSGLETGNREKVSYVLVQKNMRFV
Chloroflexus aurantiacus YP_001634433 (4) ADPLELLGIDYVEFYVSNARQAAHFYRTTLGLRPVAYAGLETGVRDRASYVLERRNVRFV
Catenulispora acidphila YP_003112250 (16) KDPFPVKGMDAVVFAVGNAKQAAHYSTAFGMRVVAYSGPETGRADRVAYVLESGSARFV
Micromonospora aurantiaca ZP06217482 (30) DPFFPVKGMDHVHFLVGNAKQAAHYYSTAFGMTCVAYRGPEQGYRDHAQYVLTSGSARFV
Salinispora tropica YP_001161056 (29) HDPFPVKGLDHVQFLVGNAKQAAHYYSTAFGMTCVAYRGPEQGYRDHAQYVLTSGSARFV
Geodermatophilus obscurus YP_003409000 (34) GDPFPVSGWDALVWVVGNATQAAHFHQSAFGMELVAYSGPETGNRDHLAYVLESGAARFV
Kribbella flavida YP_003379684   (33) TDPFPVTAMDAVVFVVGNATQTAKFYQLAFGMDLVAYAGPETGSKDAKYFVLKAGSARFV
Streptomyces aver AAA50231       (18) FPVKGMDAVVFAVGNAKQAAHYSTAFGMQLVAYSGPENGSRETASYVLTNGSARFVLTSV
Ostreococcus tauri CAL53021      (43) NAASRFGVGLGMSLRAKSDASTGNGIYASYAMKSHDLTFVFTAPYGDDERAVGCGGSSVN
Daucus carota O23920             (53) CGDATNTSRRFSWGLGMPLVAKSDLSTGNSVHASYLVRSANLSFVFTAPYSPSTTTSSGS
Solenostemon scutellarioides Q9ARF9 (45) WCGDATNTSRRFSWGLGMRFSAKSDLSTGNMVHASYLLTSGDLRFLFTAPYSPSL-SAGENPPTTT
Brassica rapa ABI63586           (61) NVARRFSWGLGMRFSAKSDLSTGNMVHASYLLTSGDLRFLFTAPYSPSL-SAGENPPTT
Coptis japonica BAF74636         (44) NTARRFSWGLGMPMVAKSDLSTGNMVHASYLLRSGELNFLFTAPYSP-S-I-AGNTLTHT
Glycine max ABQ96868             (58) NASRRFSWGLGMPIVAKSDLSTGNQIHASYLLRSGDLSFLFTAPYSPSL-S-AGSSAASS
Vitis vinifera CAN71143          (50) NLARRFSWGLGMPIVAKSDLSTGNVIHASYLLTRSGDLNFLFTAPYSPSI-AGDLENAAAT
Medicago truncatula AAX59006     (50) NTARRFSHGLGMPIVAKSDLSTGNLTHASYLLRSGDLNFLFSAAYSP-S-I-SLSSPSST
Homo sapiens 417144              (12) ERGRFLHFHSVTFWVGNAKQAASFYCSKMGFEPLAYRGLETGSREVVSHVIKQGKIVFVL
Rattus norvegicus P32755         (12) ERGRFLHFHSVTFWVGNAKQAASFYCNKMGFEPLAYKGLETGSREVVSHVIKQGKIVFVL
Mus musculus 33859486            (12) ERGRFLHFHSVTFWVGNAKQAASFYCNKMGFEPLAYRGLETGSREVVSHVIKQGKIVFVL
Bos taurus 75057880              (12) ERGRFLHFHSVTFWVGNAKQAASYCSKLGFEPLAYKGLETGSREVVSHVVKQGQIVFVF
```

Figure 10B

```
                                            121                                                                    180
Zea mays WO199704981&Seq#11         (113)  AALPSFSAAAARRFAADHGLAVRAVALRVADAEDAFRASVAAGARPAFGPVDLGRGF---
Oryza sativa BAD26248.1             (119)  ASIPSFSPGAAARRFAADHGLAVHAVALRVADADAFRASVAAGARPAFQPADLGGGF---
Avena sativa WO0246387              (113)  ASIPSFSADAARTFAAAHGLAVRSVGVRADAAEAFRVSVAGGARPAFAPADLGHGF---
Hordeum vulgare O48604              (107)  ASLPSFSADAARRFSADHGIAVRSVALRVADAAEAFRASRRGARPAFAPVDLGRGF---
Triticum aestivum AAZ67144          (109)  ASLPSFSADAARRFSADHGLAVRSIALRVADAAEAFRASVDGGARPAFSPVDLGRGF---
Acinetobacter sp 294841163          (55)   IILNYQPESYASFFFNEHGPSACAMGFKTRDAAKAFKKAVELGAEPMYSKVGPMELN---
Pseudomonas syringae NP_793333      (62)   LILNNEPHSLASYFAAEHGPSVCGMAFRVKDAQHAYNRALELGAQPLEIATGPMELR---
Legionella pneumophila 60392610     (55)   FIVNAASHCQAEAHASTHGPGACAMGFKVKDAKAAFQHAIAHGGIAFQDAPHANHGLP-
Ralstonia solanacearum 299078043    (48)   NEAVLIVNPAPNPFRDVHGASARAIAINVDNAANALAQALEGGARRATPAEFGAFVVD-
Bacillus thuringiensis YP_893139    (91)   VSGALSSDNRIAEFVKTHGDGVKDVALLVDDVDKAYSEAVKGAVAIAPPVELTDENG--
Chloroflexus aurantiacus YP_001634433 (64) LTAPLLPDHPIAQHIAHHGDGVKDIALRVRDAVTAYETAVARGGIPVQAPTEYVDEHG-
Catenulispora acidphila YP_003112250 (76)  FKGSVRPGTEIALHVAEHGDGVTDLAIAVPDVYAAYEYAVGHGATGLVEPHEVEDENG-
Micromonospora aurantiaca ZP06217482 (90)  TGAVRPDADGAEHVAK-HSDGVSDIALEVPDVDAAYAHAVAQGATGLVEPHDVSDEHG-
Salinispora tropica YP_001161056    (89)   LTGAVRPDAAGAEQVARHSDGVCDIALEVPDVDAAHAHAIAQGAISLAEPYEVSDEHG-
Geodermatophilus obscurus YP_003409000 (94) VRGAYDPASPLADHHRKHGDGIVDIALSVPDVDRCIAHAAAQGATVLEQPHDISDEFG-
Kribbella flavida YP_003379684      (93)   ISGGVRPDSPLLDHHRKHGDGVVDLALEVPDVDKCVKHARAMGATVLEEPNDVSDEHG-
Streptomyces aver AAA50231          (78)   IKPATPWGHFLADHVAEHGDGVVDLAIEVPDARAAHAYAIEHGARSVAEPYELKDEHG-
Ostreococcus tauri CAL53021         (103)  VPHPGNERGAMRFFERHGLAARAVGLRVGDARAAYEEAMKRGARGVLEPTEMRHEKHDG
Daucus carota O23920                (113)  AAIPSFSASGFHSFAAKHGLAVRAIALEVADVAAAFEASVARGARPASAPVELDDQA--
Solenostemon scutellarioides Q9ARF9 (105)  ASIPTFSFSDHRAFTSSHGLAVRAVAIQVDSASSAYSAAVSRGAKPVSPPVVIADCET-
Brassica rapa ABI63586              (120)  ASIPSFDHVTYRSFFSSHGLGVRAVAVFVEDAEAAFSISVSNGAVPSSPPIVLNDAV--
Coptis japonica BAF74636            (101)  ASIPTYSHNLARLFASTHGLAVRAIAIEVQDAELAYNISVANGAKPSSSPIKLDEGV--
Glycine max ABQ96868                (116)  ASIPSFDAATCLAFAAKHGFGVRAIALEVADAEAAFSASVAKGAEPASPPVLVDDRT--
Vitis vinifera CAN71143             (109)  ASIPSFDHSACHAFAASHGLGVRAIAIEVDDAEGAFHTSVAHGARPMSPPVTMGGSV--
Medicago truncatula AAX59006        (107)  AAIPTFSASTCFSFSASHGLAVRAVAVEVEDAEVAFTTSVNLGAIPSSPPVILENNV--
Homo sapiens 417144                 (72)   SSALNPWNKEMGDHLVKHGDVIAFEVEDCDYIVQKARERGAKIMREPWVEQDKFG----
Rattus norvegicus P32755            (72)   CSALNPWNKEMGDHLVKHGDVIAFEVEDCEHIVQKARERGAKIVREPWVEEDKFG----
Mus musculus 33859486               (72)   CSALNPWNKEMGDHLVKHGDVIAFEVEDCDHIVQKARERGAKIVREPWVEQDKFG----
Bos taurus 75057880                 (72)   SSALNPWNKEMGDHLVKHGDVIAFEVEDCDYIVQKARERGAKIVREPWVEQDKLG----
```

Figure 10C

```
                                                181                                                                              240
   Zea mays WO199704 9816Seq#11 (170) ------RLAEVELYGDVLRYVSYPDGAA-------GEPFLPGFEGVASPGAA------D-
       Oryza sativa BAD26248.1   (176) ------GLAEVELYGDVVLRFVSHPDGA-------DAPFLPGFEGVSNPGAV------D-
       Avena sativa WO0246387    (170) ------GLAEVELYGDVVLRFVSYPDET-------DLPFLPGFEGVSSPGAV------D-
    Hordeum vulgare O48604       (164) ------AFAEVELYGDVVLRFVSHPDGT-------DVPFLPGFEGVTNPDAV------D-
   Triticum aestivum AAZ67144    (166) ------GFAEVELYGDVVLRFVSHPDDT-------DVPFLPGFEGVSNPDAV------D-
    Acinetobacter sp 294841163   (112) ---------IPAIKGIGGMPIFLVDRDIYEN-------DFVFFDDAQRNPEG-------
  Pseudomonas syringae NP_793333 (119) --------LPAIKGIGGAPLYLIDRFGEGTS-------IYDIDFNFIEGVDRHPVG----
    Legionella pneumophila 60392610 (113) -----------AIQAIGGSVIYFVDEEHQP-------FSHEWNITSPEPVVG--------
   Ralstonia solanacearum 29907804 3 (106) ----------AQAIVGIGDSLVYFVDHDIES-------VFSTPYRPRQPVDVAN-------
  Bacillus thuringiensis YP_893139 (149) ----------TLKKAVIGTYGDTIHTLVERKNYKG-------TFMPGFQKAEFDIPFE-----E-
Chloroflexus aurantiacus YP_001634433 (122) ----------RIIKATIATYGDTVHSFIERENYQG-------TFMPGFQPITTLPVP-----E-
Catenulispora acidiphila YP_003112250 (134) ----------VLVRAAIATYGDTRHSLVDRSRYTG-------AYAPGYVERAPLVEPN-----A-
Micromonospora aurantiaca ZP06217482 (147) ----------TVRMASIAAYGDTRHSLVDRSRYTG-------PFLPGFVARGPIVDRQPMIDAG
Salinispora tropica YP_001161056   (147) ----------TVRLAAIATYGDTRHTLVDRSRYHG-------PFLPGYVARRPIVDRQPMIDAG
Geodermatophilus obscurus YP_003409000 (152) ----------TVRIGAIATYGDTRHTLVDRSRYTG-------PYLPGYVERRSSHVKRDG----
  Kribbella flavida YP_003379684 (151) ----------TVRRAAIAAYGDTRHTLIDRSRYDG-------PYLPGFVAATTAVTRPEG----
   Streptomyces aver AAA50231    (136) ----------TVVLAAIATVGKTRHTLVDRTGYDG-------PYLPGYVAAAPIVEPP-----
   Ostreococcus tauri CAL53021   (163) CVMGTQIISEVELYGDVVLRFVSRADGFDG-------DFLCNYEATRDVPSVS-------
     Daucus carota O23920        (170) ----------WLAEVELYGDVVLRFVSFGREE-------GLFLPGFEAVEGTASFPDL---D-
Solenostemon scutellarioides Q9ARF9 (163) ----------AIAEVHLYGDVVLRFVSCGSGA-------DGWFLPGFEVVGDGVSCQEL---D-
      Brassica rapa ABI63586      (177) ----------TIAEVKLYGDVVLRYVSYKVAT-------VFLPRFETVDDTSSFP-L---D-
     Coptis japonica BAF74636     (158) ----------VLSEIQLYGDVVLRYLSFKNTN-------QSCPFLPGFEEVGEVSSSRGL---D-
      Glycine max ABQ96868         (173) ----------GFAEVRLYGDVVLRYVSYKDAAPQAPHADPSRWFLPGFEAAASSSFPEL---D-
     Vitis vinifera CAN71143       (166) ----------VISEVHLYGDAVLRYVSYKNPNPNA-TSDPSSWFLPGFEAVDEGSSFP-V---D-
  Medicago truncatula AAX59006    (164) ----------KLAEVHLYGDVVLRYVSYNDLNP---NQNPNLFFLPGFERVSDESSNSSL---D-
      Homo sapiens 417144           (130) ----------KVKFAVLQTYGDTTHTLVEKMNYIG-------QFLPGYEAPAFMDPLLPKLPK-
   Rattus norvegicus P32755        (130) ----------KVKFAVLQTYGDTTHTLVEKINYTG-------RFLPGFEAPTYKDTLLPKLPS-
      Mus musculus 33859486         (130) ----------KVKFAVLQTYGDTTHTLVEKINYTG-------RFLPGFEAPTYKDTLLPKLPR-
       Bos taurus 75057880           (130) ----------KVKFAVLQTYGDTTHTLVEKMNYTG-------RFLPGFEAPFMDPQLSKLPS-
```

Figure 10D

```
                                          241                                                                                    300
Zea mays WO199704981;Seq#11         (211) ----YGLSRFDHIVGNVPE--LAPAAAYFAGFTGFHEFAEFTTEDVGTAESGLNSMVLAN
Oryza sativa BAD26248.1             (216) ----YGLRRFDHVVGNVPE--LAPVAAYISGFTGFHEFAEFTAEDVGTAESGLNSVVLAN
Avena sativa WO0246387              (210) ----YGLTRFDHVVGNVPE--MAPVIDMKGFLGFHEFAEFTAEDVGTTESGLNSVVLAN
Hordeum vulgare O48604              (204) ----YGLTRFDHVVGNVPE--LAPAAAYIAGFTGFHEFAEFTAEDVGTTESGLNSVVLAN
Triticum aestivum AAZ67144          (206) ----YGLTRFDHVVGNVPE--LAPAAAYVAGFAGFHEFAEFTTEDVGTAESGLNSMVLAN
Acinetobacter sp 294841163          (148) ----AGLKEIDHLTHNVYKGRMEYWANFYEKIFNFQEIRYF---DIKGEYTGLTSKALTA
Pseudomonas syringae NP_793333      (160) ----AGLKFIDHLTHNVYRGRMAYWANFYEKLFNFRELRYF---DIKGEYTGLTSKAMSA
Legionella pneumophila 60392610     (147) ----NGLTAIDHLTHNVYRGNMDKWASFYASIFNFQEIRFFN--IKGKMTGLVSRALGS
Ralstonia solanacearum 299078043    (143) ----AAIQAIDHTSNIVKPENLDHWADFYKDTFAFVQKQYL---DVKGRQTGMRARSMVS
Bacillus thuringiensis YP_893139    (191) ----SGLIAVDHVVGNVEK--MEEWVSXYENVMGFKQMIHFDDDISTEYSALMSKVMTN
Chloroflexus aurantiacus YP_001634433 (164) ----TGIAAIDHIVGNVBLGAMNRWVNYXRDVLGFSQLVHFDDHDISTEYSALMSKVMQN
Catenulispora acidphila YP_003112250 (176) ----RIFQAIDHCVGNVELGKMDEWVDFYRHVMGFTNMABFIGDDIATDYSALMSKVVAD
Micromonospora aurantiaca ZP06217482 (194) LQPKRFFQAVDHVVGNVELGRMDEWVEFYKRVMGFSNMABFIGDDIATDYSALMSKVVAN
Salinispora tropica YP_001161056    (194) VQPKRFFQAIDHVVGNVELGRMDEWVEFYQRVMGFTNMABFVGDDIATDYSALMSKVVAN
Geodermatophilus obscurus YP_003409000 (195) -APKRLFQAVDHVVGNVELGAMDRWVEFYNRVMGFTNMABFVGEDIATDYSALMSKVVAN
Kribbella flavida YP_003379684      (194) -HPKRLFQAVDHVVGNVELGKMDEWVGFYNKVMGFVNMABFIGDDIATDYSALMSKVVAN
Streptomyces aver AAA50231          (177) -AHRTFQAIDHCVGNVELGRMNEWVGFYNKVMGFTNMKBFVGDDIATEYSALMSKVVAD
Ostreococcus tauri CAL53021         (209) ----YGIRRIDHAVGNVHN--LLFTVDYIMKITGFHBFAEFTAEDIGTIDSGLNSMVLAN
Daucus carota 023920                (212) ----YGIRRLDHAVGNVTE--LGPVVFYIKGFTGFHEFAEFTAEDVGTTLESGLNSVVLAN
Solenostemon scutellarioides Q9ARF9 (206) ----YGIRRLDHAVGNVPK--LEPVVDYLKKFTGFHEFAEFTAEDVGTAESGLNSVVLAN
Brassica rapa ABI63586              (217) ----YGIRRLDHAVGNVPE--LGPALTYLSRLTGFHQFAEFTADDVGTAESGLNSAVLAN
Coptis japonica BAF74636            (202) ----YGIRRLDHAVGNVPN--LAEAICYLKEFTGFHEFAEFTAEDVGTTESGHNSIVLAS
Glycine max ABQ96868                (224) ----YGIRRLDHAVGNVPK--LAPAVRYLKGFSGFHEFAEFTAEDVGTSESGLNSVVLAN
Vitis vinifera CAN71143             (215) ----FGIRRVDHTVGNVPK--LAPVVTYLKQFTGFHEFAEFTAEDVGTSESGLNSVVLAS
Medicago truncatula AAX59006        (212) ----FGIRRLDHAVGNVPK--LSSAVKYVKQFTGFHEFAEFTAEDVGTSESGLNSVLIAN
Homo sapiens 417144                 (176) ----CSLEMIDHIVGNQPDQEMVSASEWYLKNLQFHRFWSVDDTQVHTEYSSLRSIVVAN
Rattus norvegicus P32755            (176) ----CNLEIIDHIVGNQPDQEMESASEWYLKNLQFHRFWSVDDTQVHTEYSSLRSIVVAN
Mus musculus 33859486               (176) ----CNLEIIDHIVGNQPDQEMQSASEWYLKNLQFHRFWSVDDTQVHTEYSSLRSIVTN
Bos taurus 75057880                 (176) ----CSLEIIDHIVGNQPDQEMVSASEWYLKNLQFHRFWSVDDTQVHTEYSSLRSVVAN
```

```
                                              361                                                            420
Zea mays WO199704981&Seq#11      (323) GFEEMAPPTSDYXDGVRRRAGDVLTEAQI--KECQELGVLVDRDDQG----VLLQIFTKP
Oryza sativa BAD26248.1          (328) GFEELAPPPPNYDGVRRRAGDVLSEEQI--NECQELGVLVDRDDQG----VLLQIFTKP
Avena sativa WO0246387           (322) GFEEMAPPQAKVYEGVRRIAGDVLSEEQI--KECQELGVLVDRDDQG----VLLQIFTKP
Hordeum vulgare O48604           (316) GFDELPPPLPKVYEGVRRLAGDVLSEAQI--KECQELGVLVDRDDQG----VLLQIFTKP
Triticum aestivum AAZ67144       (318) GFDELPPPRCRKVYEGVRRIAGDVLSEAQI--KECQELGVLVDRDDQG----VLLQIFTKP
Acinetobacter sp 294841163       (256) ---FMTPPENTYYEMLEERLP--EHGEPT--EELKQRGLLLDGSTKDGQKKLLLQIFSEN
Pseudomonas syringae NP_793333   (268) ---FMTAPPDTYYEMLQGRLP--DHGEPE--AELKSRGLLLDGSSEGGERRLLLQIFSAT
Legionella pneumophila 60392610  (254) ---FLDVPDTYYEMINDRLP--WHKEPLN--QEHAEKLLIDGEADPKDG-LLLQIFTEN
Ralstonia solanacearum 299078043 (254) ---FMDTPPKTYYQNLDVRVPGHGQNLDS----VERRGLLVDGKGDG----RILLQRFTRR
Bacillus thuringiensis YP_893139 (300) ---FLDTPDTYVDELTARVGKIDEEID----KLKELKILVDRDDEG----YLLQIFTKP
Chloroflexus aurantiacus YP_001634433 (276) ---FIHVPDAVYDDLEERVGKIDESRQ----ALQERGILVDRDEEG----YLLQIFSQP
Catenulispora acidiphila YP_003112250 (288) ---FLETPDSYYEDEELRARIGTVRVPV--EELQKRKILVDRDREG----YLLQIFTKP
Micromonospora aurantiaca ZP06217482 (310) ---FLDTPDSYYEDPELRARIGNVRVPI--EELQSRKILVDRDEDG----YLLQIFTKP
Salinispora tropica YP_001161056 (310) ---FLDTPDSYYDDPELRARIGEVRVPI--EELKARRILVDRDEDG----YLLQIFTNP
Geodermatophilus obscurus YP_003409000 (310) ---FLATPDSYYEDPELRARIGEVRAPI--EELQERGVLVDRDEDG----YLLQIFTKP
Kribbella flavida YP_003379684   (309) ---FLNTPDSYYEDPELRARIGNVRAPI--EELQARGILVDRDEDG----YLLQIFTAP
Streptomyces aver AAA50231       (291) ---FLDTPDSYYDTLGEWVG--DTRVPV--DTLREKILADRDEDG----VLLQIFTKP
Ostreococcus tauri CAL53021      (322) GFDEQAPASDDYKHLKEKIGDALTDEQY--ALVEELGLLVMDKDDQG--VLIQVFTKP
Daucus carota O23920             (324) GFEEMPSPPPTYKNLKNRVGDVLSDEQI--KECEDLGILVDRDDQG----KECEKLGILIDRDDQG-- (editing) 
```

|                                            |       | 481          |
|--------------------------------------------|-------|--------------|
| Zea mays WO1997049816Seq#11                | (436) | AAAAAAQGS-   |
| Oryza sativa BAD26248.1                    | (441) | PTVQGS----   |
| Avena sativa WO00246387                    | (435) | VVAQKS----   |
| Hordeum vulgare O48604                     | (429) | AAVQGS----   |
| Triticum aestivum AAZ67144                 | (431) | AAVQGS----   |
| Acinetobacter sp 294841163                 | (351) | K---------   |
| Pseudomonas syringae NP_793333             | (363) | D---------   |
| Legionella pneumophila 60392610            | (347) | LS--------   |
| Ralstonia solanacearum 299078043           | (346) | S---------   |
| Bacillus thuringiensis YP_893139           | (390) | ----------   |
| Chloroflexus aurantiacus YP_001634433      | (366) | ----------   |
| Catenulispora acidphila YP_003112250       | (380) | ----------   |
| Micromonospora aurantiaca ZP06217482       | (402) | ----------   |
| Salinispora tropica YP_001161056           | (402) | ----------   |
| Geodermatophilus obscurus YP_003409000     | (402) | ----------   |
| Kribbella flavida YP_003379684             | (401) | ----------   |
| Streoptomyces aver AAA50231                | (381) | ----------   |
| Ostreococcus tauri CAL53021                | (433) | TGSAAAA---   |
| Daucus carota O23920                       | (437) | TKTAMA----   |
| Solenostemon scutellarioides Q9ARF9        | (431) | VG--------   |
| Brassica rapa ABI63586                     | (442) | VVAA------   |
| Coptis japonica BAF74636                   | (427) | A-GLT-VNS-   |
| Glycine max ABQ96868                       | (449) | VDPAPV----   |
| Vitis vinifera CAN71143                    | (440) | A---------   |
| Medicago truncatula AAX59006               | (437) | ----------   |
| Homo sapiens 417144                        | (384) | METNGVVPGM   |
| Rattus norvegicus P32755                   | (384) | LETNGVRSGM   |
| Mus musculus 33859486                      | (384) | LEPNGVRSGM   |
| Bos taurus 75057880                        | (384) | MEPNGVVSGM   |

Figure 10I

1 75
Sorghum bicolor HPPD designed (1) MPPTPTTAAATGAAVAAASAEQAAFRLVGHRNFVRVNPRSDRFHTLAFHHVELWCADAASAAGRFSFGLGAPLAA
Sorghum bicolor XP_002453359 (1) MPPTPTTAAATGAAVAAASAEQAAFRLVGHRNFVRVNPRSDRFHTLAFHHVELWCADAASAAGRFSFGLGAPLAA
76 150
Sorghum bicolor HPPD designed (76) RSDLSTGNTAHASLLLRSGALAFLFTAPYAHGADAATASLPSFSAAEARRFAADHGLAVRAVALRVADAEDAFRA
Sorghum bicolor XP_002453359 (76) RSDLSTGNTAHASLLLRSGALAFLFTAPYAHGADAATASLPSFSAAEARRFAADHGLAVRAVALRVADAEDAFRA
151 225
Sorghum bicolor HPPD designed (151) SVAAGARPAFEPVELGLGFRLAEVELYGDVVLRYVSYPDDADASFLPGFVGVASPGAADYGLRRFDHIVGNVPEL
Sorghum bicolor XP_002453359 (151) SVAAGARPAFEPVELGLGFRLAEVELYGDVVLRYVSYPDDADASFLPGFVGVTSPGAADYGLRRFDHIVGNVPEL
226 300
Sorghum bicolor HPPD designed (226) APAAAYMAGFTGFHEFAEFTAEDVGTTESGLNSMALANNAENVLLPLNEPVHGTKRRSQIQTYLDHHGGPGVQHI
Sorghum bicolor XP_002453359 (226) APAAAYFAGFTGFHEFAEFTAEDVGTTESGLNSMVLANNAENVLLPLNEPVHGTKRRSQIQTYLDHHGGPGVQHM
301 375
Sorghum bicolor HPPD designed (301) ALASDDVLRTLREMQARSAMGGFEFLPPPLSEYYDGVRRCAGDVLTEAQIKECQELGVMVDRDDQGVLLQIFTKP
Sorghum bicolor XP_002453359 (301) ALASDDVLRTLREMQARSAMGGFEFMAPPAPEYYDGVRRRAGDVLTEAQIKECQELGVLVDRDDQGVLLQIFTKP
376 440
Sorghum bicolor HPPD designed (376) VGDRPTLFLEIIQRIGCMEKDEKGQEYQKGGCGGFGKGNFGQLFKSIEDYEKSLEAKQAAAAQGS
Sorghum bicolor XP_002453359 (376) VGDRPTLFLEIIQRIGCMEKDEKGQEYQKGGCGGFGKGNFSQLFKSIEDYEKSLEAKQAAAAQGS 1 75
Glycine max designed HPPD (1) MCNEIQAQAQAQAQPGFKLVGFKNFVRTNPKSDRFQVNRFHHIEFWCTDATNASRRFSWGLGMPIVAKSDLSTGN
Glycine max ABQ96868 HPPD (1) MCNEIQAQAQAQAQPGFKLVGFKNFVRTNPKSDRFQVNRFHHIEFWCTDATNASRRFSWGLGMPIVAKSDLSTGN
76 150
Glycine max designed HPPD (76) QIHASYLLRSGDLSFLFSAPYSPSLSAGSSAASSASIPSFDAATCLAFAAKHGFGVRAIALEVADAEAAFSASVA
Glycine max ABQ96868 HPPD (76) QIHASYLLRSGDLSFLFSAPYSPSLSAGSSAASSASIPSFDAATCLAFAAKHGFGVRAIALEVADAEAAFSASVA
151 225
Glycine max designed HPPD (151) KGAEPASPPVLVDDRTGFAEVRLYGDVVLRYVSYKDAAPQAPHADPSRWFLPGFEAAASSSSFPELDYGIRRLDH
Glycine max ABQ96868 HPPD (151) KGAEPASPPVLVDDRTGFAEVRLYGDVVLRYVSYKDAAPQAPHADPSRWFLPGFEAAASSSSFPELDYGIRRLDH
226 300
Glycine max designed HPPD (226) AVGNVPELAPAVAYMAGFSGFHEFAEFTAEDVGTSESGLNSMALANNSETVLLPLNEPVYGTKRKSQIETYLEHN
Glycine max ABQ96868 HPPD (226) AVGNVPELAPAVRYLKGFSGFHEFAEFTAEDVGTSESGLNSVVLANNSETVLLPLNEPVYGTKRKSQIETYLEHN
301 375
Glycine max designed HPPD (301) EGAGVQHLALVTHDIFTTLREMRKRSFLGGFEFMPSPPPTYYANLHNCAADVLTVDQIKQCEELGIMVDRDDQGT
Glycine max ABQ96868 HPPD (301) EGAGVQHLALVTHDIFTTLREMRKRSFLGGFEFMPSPPPTYYANLHNRAADVLTVDQIKQCEELGILVDRDDQGT
376 443
Glycine max designed HPPD (376) LLQIFTKPVGDRPTIFIXIIQRIGCMVEDEEGKVYQKGACGGFGKGNFGELFKSIEEYEKTLEAKRTA
Glycine max ABQ96868 HPPD (376) LLQIFTKPVGDRPTIFIXIIQRIGCMVEDEEGKVYQKGACGGFGKGNFSELFKSIEEYEKTLEAKRTA

Figure 14

COMPOSITIONS AND METHODS COMPRISING SEQUENCES HAVING HYDROXYPHENYLPYRUVATE DIOXYGENASE (HPPD) ACTIVITY

CROSS-REFERENCE TO RELATED APPLICATION

This application claims the benefit of U.S. Provisional Application Ser. No. 61/401,456, filed Aug. 13, 2010; U.S. Provisional Ser. No. 61/393,507, filed Oct. 15, 2010; and, U.S. Provisional Ser. No. 61/501,042, filed Jun. 24, 2011; each of which is herein incorporated by reference.

FIELD OF THE INVENTION

This invention is in the field of molecular biology. More specifically, this invention pertains to herbicide tolerance conferred by expression of a sequence that confers tolerance to a 4-hydroxyphenylpyruvate dioxygenase inhibitor (HPPD).

REFERENCE TO A SEQUENCE LISTING SUBMITTED AS A TEXT FILE VIA EFS-WEB

The official copy of the sequence listing is submitted concurrently with the specification as a text file via EFS-Web, in compliance with the American Standard Code for Information Interchange (ASCII), with a file name of 408350SEQLIST.txt, a creation date of Aug. 11, 2011, and a size of 1.58 MB. The sequence listing filed via EFS-Web is part of the specification and is hereby incorporated in its entirety by reference herein

BACKGROUND OF THE INVENTION

In the commercial production of crops, it is desirable to easily and quickly eliminate unwanted plants (i.e., "weeds") from a field of crop plants. An ideal treatment would be one which could be applied to an entire field but which would eliminate only the unwanted plants while leaving the crop plants unharmed. One such treatment system would involve the use of crop plants which are tolerant to a herbicide so that when the herbicide was sprayed on a field of herbicide-tolerant crop plants, the crop plants would continue to thrive while non-herbicide-tolerant weeds were killed or severely damaged. Ideally, such treatment systems would take advantage of varying herbicide properties so that weed control could provide the best possible combination of flexibility and economy. For example, individual herbicides have different longevities in the field, and some herbicides persist and are effective for a relatively long time after they are applied to a field while other herbicides are quickly broken down into other and/or non-active compounds. An ideal treatment system would allow the use of different herbicides so that growers could tailor the choice of herbicides for a particular situation.

Crop tolerance to specific herbicides can be conferred by engineering genes into crops which encode appropriate herbicide metabolizing enzymes and/or insensitive herbicide targets. In some cases these enzymes, and the nucleic acids that encode them, originate in a plant. In other cases, they are derived from other organisms, such as microbes. See, e.g., Padgette et al. (1996) "New weed control opportunities: Development of soybeans with a Roundup Ready® gene" and Vasil (1996) "Phosphinothricin-resistant crops," both in *Herbicide-Resistant Crops*, ed. Duke (CRC Press, Boca Raton, Fla.) pp. 54-84 and pp. 85-91. Indeed, transgenic plants have been engineered to express a variety of herbicide tolerance genes from a variety of organisms.

While a number of herbicide-tolerant crop plants are presently commercially available, improvements in every aspect of crop production, weed control options, extension of residual weed control, and improvement in crop yield are continuously in demand. Particularly, due to local and regional variation in dominant weed species as well as preferred crop species, a continuing need exists for customized systems of crop protection and weed management which can be adapted to the needs of a particular region, geography, and/or locality. A continuing need therefore exists for compositions and methods of crop protection and weed management.

BRIEF SUMMARY OF THE INVENTION

Compositions and methods comprising polynucleotides and polypeptides having 4-hydroxyphenylpyruvate dioxygenase (HPPD) activity and having an insensitivity to at least one HPPD inhibitor are provided. Further provided are nucleic acid constructs, plants, plant cells, explants, seeds and grain having the HPPD sequences.

Various methods of employing the HPPD sequences are provided. Such methods include methods for producing an HPPD inhibitor tolerant plant, plant cell, explant or seed and methods of controlling weeds in a field containing a crop employing the plants and/or seeds disclosed herein.

Methods are also provided to identify additional HPPD variants.

Further provided are methods and compositions that allow the various HPPD polypeptides and variant and fragments thereof to be expressed in a chloroplast or transported to a chloroplast. Such methods and compositions find use in producing plant cells, plants and explants having tolerance to various HPPD inhibitors.

BRIEF DESCRIPTION OF THE DRAWINGS

FIG. 2 illustrates the contacting reaction velocity in the 70-90 second interval of maize wild-type HPPD verses an improved variant. FIG. 2A shows the maize wild-type HPPD characterization with mesotrione inhibitor. FIG. 2B shows an HPPD variant (D0223944) with improved ON rate ratio.

FIG. 3 illustrates the contrasting time span in which maize wild-type HPPD and the improved variant dissociate from mesotrione, as indicated in the accelerating reaction rates. FIG. 3A represents the reaction for the maize wild-type HPPD. FIG. 3B shows the reaction for the HPPD variant (D0223944) with improved OFF rate ratio.

FIG. 4 provides an amino acid alignment of HPPD from various monocots. HPPD from *Hordeum vulgare* is set forth in SEQ ID NO: 328. HPPD from *Avena sativa* is set forth in SEQ ID NO: 329. HPPD from *Oryza sativa* is set forth in SEQ ID NO:330. HPPD from *Triticum aestivum* is set forth in SEQ ID NO: 331. HPPD from *Zea mays* is set forth in SEQ ID NO: 392. The underlining demonstrates amino acid residues sharing identity and further displays the consensus regions.

FIG. 5A-5D provides an amino acid alignment of HPPD from various dicots. HPPD from *Zea mays* is set forth in SEQ ID NO: 1. HPPD from *Daucus carota* is set forth in SEQ ID NO:332. HPPD from *Solenosteman sautellarioides* is set forth in SEQ ID NO: 333. HPPD from *Picea Sitchensis* is set forth in SEQ ID NO: 334. HPPD from *Abutilon theophrasti* is set forth in SEQ ID NO: 335. HPPD from *Arabidopsis thaliana* is set forth in SEQ ID NO: 336. HPPD from *Brassica rapa* is set forth in SEQ ID NO: 337. HPPD from *Coptis japonica* is set forth in SEQ ID NO: 338. HPPD from *Vitis vinifera* is set forth in SEQ ID NO: 339. HPPD from *Glycine max* is set forth in SEQ ID NO: 2. HPPD from *Medicago truncatula* is set forth in SEQ ID NO: 340. The grey shading demonstrates the consensus regions.

FIG. 7A shows fluorescence observed in maize leaf transfected with ZmRCA1-Pro::RCA1CTP-Ds-Red2, 1000×. FIG. 7B shows fluorescence observed in maize leaf transfected with ZmRCA1-Pro::N-term-ZmHPPD-Ds-Red2, 1000×. Figure C shows fluorescence observed in maize leaf transfected with untargeted Ds-Red2, 1000×.

FIG. 8A-D provides an alignment showing the diversity found in the N-terminal amino acids of HPPD polypepties from moncots, dicots, microbes and mammals. SEQ ID NO: 341 provides the N-terminal amino acid sequence for *Zea mays*; SEQ ID NO: 342 provides the N-terminal amino acid sequence for *Oryza sativa*; SEQ ID NO: 343 provides the N-terminal amino acid sequence for *Avena sativa*; SEQ ID NO: 344 provides the N-terminal amino acid sequence for *Hordeum vulgare*; SEQ ID NO: 345 provides the N-terminal amino acid sequence for *Triticum aestivum*; SEQ ID NO: 346 provides the N-terminal amino acid sequence for *Pseudomonas syringae*; SEQ ID NO: 347 provides the N-terminal amino acid sequence for *Legionella pneumophila*; SEQ ID NO: 348 provides the N-terminal amino acid sequence for *Ralstonia solanacearum*; SEQ ID NO: 349 provides the N-terminal amino acid sequence for *Bacillus thuringiensis*; SEQ ID NO: 350 provides the N-terminal amino acid sequence for *Chloroflexus aurantiacus*; SEQ ID NO: 351 provides the N-terminal amino acid sequence for *Acinetobacter*; SEQ ID NO: 352 provides the N-terminal amino acid sequence for *Catenulispora acidphila*; SEQ ID NO: 353 provides the N-terminal amino acid sequence for *Micromonospora aurantiaca*; SEQ ID NO: 354 provides the N-terminal amino acid sequence for *Calinispora tropica*; SEQ ID NO: 355 provides the N-terminal amino acid sequence for *Geodermatophilus obscurus*; SEQ ID NO: 356 provides the N-terminal amino acid sequence for *Kibbella flavida*; SEQ ID NO: 357 provides the N-terminal amino acid sequence for *Streptomyces avermitilis*; SEQ ID NO: 358 provides the N-terminal amino acid sequence for *Ostreococcus tauri*; SEQ ID NO: 359 provides the N-terminal amino acid sequence for *Daucus carota*; SEQ ID NO: 360 provides the N-terminal amino acid sequence for *Solernostemon scutellariuides*; SEQ ID NO: 361 provides the N-terminal amino acid sequence for *Brassica rapa*; SEQ ID NO: 362 provides the N-terminal amino acid sequence for *Coptis japonica*; SEQ ID NO: 363 provides the N-terminal amino acid sequence for *Glycine max*; SEQ ID NO: 364 provides the N-terminal amino acid sequence for *Vitis vinifera*; SEQ ID NO: 365 provides the N-terminal amino acid sequence for *Medicago truncatula*; SEQ ID NO: 366 provides the N-terminal amino acid sequence for *Homo sapiens*; SEQ ID NO: 367 provides the N-terminal amino acid sequence for *Rattus norvegicus*; SEQ ID NO: 368 provides the N-terminal amino acid sequence for *Mus musculus*; and, SEQ ID NO: 369 provides the N-terminal amino acid sequence for *Bos Taurus*.

FIG. 9A provides a *Sorghum bicolor* native HPPD (SEQ ID NO: 394); a *Sorghum bicolor* variant HPPD (SEQ ID NO:393) and FIG. 9B provides a *Glycine max* native HPPD (SEQ ID NO: 396) and a *glycine max* variant HPPD (SEQ ID NO: 395), where the variant sequences are based on motifs unique to improved maize HPPD sequences. Bold, underlined sequences represent HPPD motifs unique to improved maize HPPD sequences.

FIG. 10A-I provides an alignment of additional HPPD sequences. The *Zea mays* HPPD sequence is set forth in SEQ ID NO: 392; the *Oryza sativa* HPPD sequence is set forth in SEQ ID NO: 330; the *Avena sativa* HPPD sequence is set forth in SEQ ID NO: 329; the *Hordeum vulgare* HPPD sequence is set forth in SEQ ID NO: 328; the *Triticum aestivum* HPPD sequence is set forth in SEQ ID NO: 331; the *Acinetobacter* sp HPPD sequence is set forth in SEQ ID NO: 466; the *Pseudomonas syringae* HPPD sequence is set forth in SEQ ID NO: 467; the *Legionella pneumophila* HPPD sequence is set forth in SEQ ID NO: 468; the *Ralstonia solanacearum* HPPD sequence is set forth in SEQ ID NO: 469; the *Bacillus thuringiensis* HPPD sequence is set forth in SEQ ID NO: 470; the *Chloroflexus aurantiacus* HPPD sequence is set forth in SEQ ID NO: 471; the *Catenulispora acidphila* HPPD sequence is set forth in SEQ ID NO: 472; the *Micromonospora aurantiaca* HPPD sequence is set forth in SEQ ID NO:473; the *Salinispora tropica* HPPD sequence is set forth in SEQ ID NO:474; the *Geodermatophilus obscurus* HPPD sequence is set forth in SEQ ID NO:475; the *Kribbella flavida* HPPD sequence is set forth in SEQ ID NO:476; the *Streptomyces aver* HPPD sequence is set forth in SEQ ID NO:477; the *Ostreococcus tauri* HPPD sequence is set forth in SEQ ID NO:478; the *Daucus carota* HPPD sequence is set forth in SEQ ID NO:479; the *Solenostemon scutellarioides* HPPD sequence is set forth in SEQ ID NO:480; the *Brassica rapa* HPPD sequence is set forth in SEQ ID NO:481; the *Coptis japonica* HPPD sequence is set forth in SEQ ID NO:482; the *Glycine max* HPPD sequence is set forth in SEQ ID NO:483; the *Vitis vinifera* HPPD sequence is set forth in SEQ ID NO:484; the *Medicago truncatula* HPPD sequence is set forth in SEQ ID NO:485; the *Homo sapiens* HPPD sequence is set forth in SEQ ID NO:486; the *Rattus norvegicus* HPPD sequence is set forth in SEQ ID NO:487; the *Mus musculus* HPPD sequence is set forth in SEQ ID NO:488; and, the *Bos taurus* HPPD sequence is set forth in SEQ ID NO:489.

FIG. 14 provides a *Sorghum bicolor* native HPPD (SEQ ID NO: 394); a *Sorghum bicolor* variant HPPD (SEQ ID NO:459); a *Glycine max* native HPPD (SEQ ID NO: 396) and a *Glycine max* variant HPPD (SEQ ID NO: 458), where the variant sequences are based on motifs unique to improved maize HPPD sequences. Bold, underlined sequences represent HPPD motifs unique to improved maize HPPD sequences.

DETAILED DESCRIPTION OF THE INVENTION

The present inventions now will be described more fully hereinafter with reference to the accompanying drawings, in which some, but not all embodiments of the inventions are shown. Indeed, these inventions may be embodied in many different forms and should not be construed as limited to the embodiments set forth herein; rather, these embodiments are provided so that this disclosure will satisfy applicable legal requirements. Like numbers refer to like elements throughout.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

I. Compositions

A. Hydroxyphenylpyruvate Dioxygenase (HPPD) Polynucleotides and Polypeptides Hydroxyphenylpyruvate dioxygenase (HPPD) converts hydroxyphenylpyruvate, derived from the aromatic amino acid biosynthesis pathway, to homogentisate. Homogentisate is a precursor of tocopherols and plastoquinones, an electron carrier essential in the biosynthesis of carotenoids. Consequently, when HPPD is inhibited by herbicide inhibitors, the plant can not protect itself from the radicals generated by light activation of chlorophyll. More specifically, inhibition of HPPD polypeptide leads to the depletion of protective pigments in the plant tissue resulting in bleaching of tissues which leaves the plants vulnerable to damage by light. HPPD inhibitors are an important class of herbicides and transgenes that confer crop tolerance to HPPD inhibitors would be of significant value, especially for managing weed resistance to glyphosate.

Figure 1:
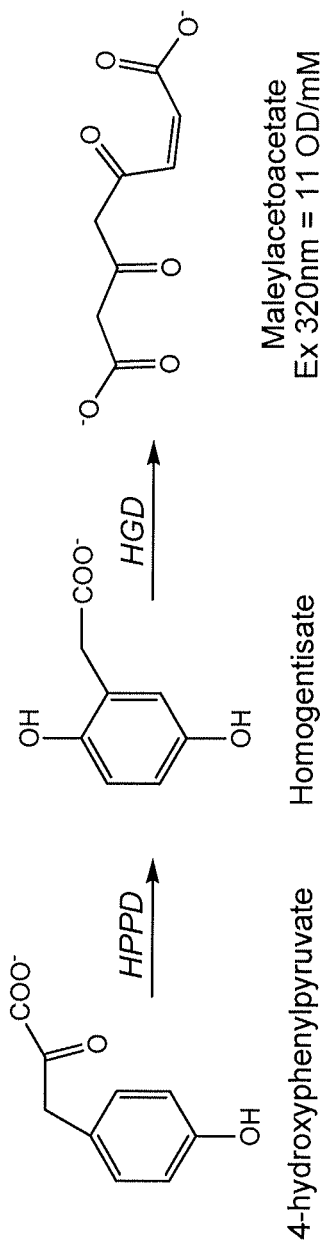
FIG. 1 provides the chemical reaction converting 4-hydroxyphenylpyruvate (HPP) to homogentisate to maleylacetoacetate. HPPD=4-hydroxyphenylpyruvate dioxygenase; HGD=homogentisate dioxygenase.
Figure 4:
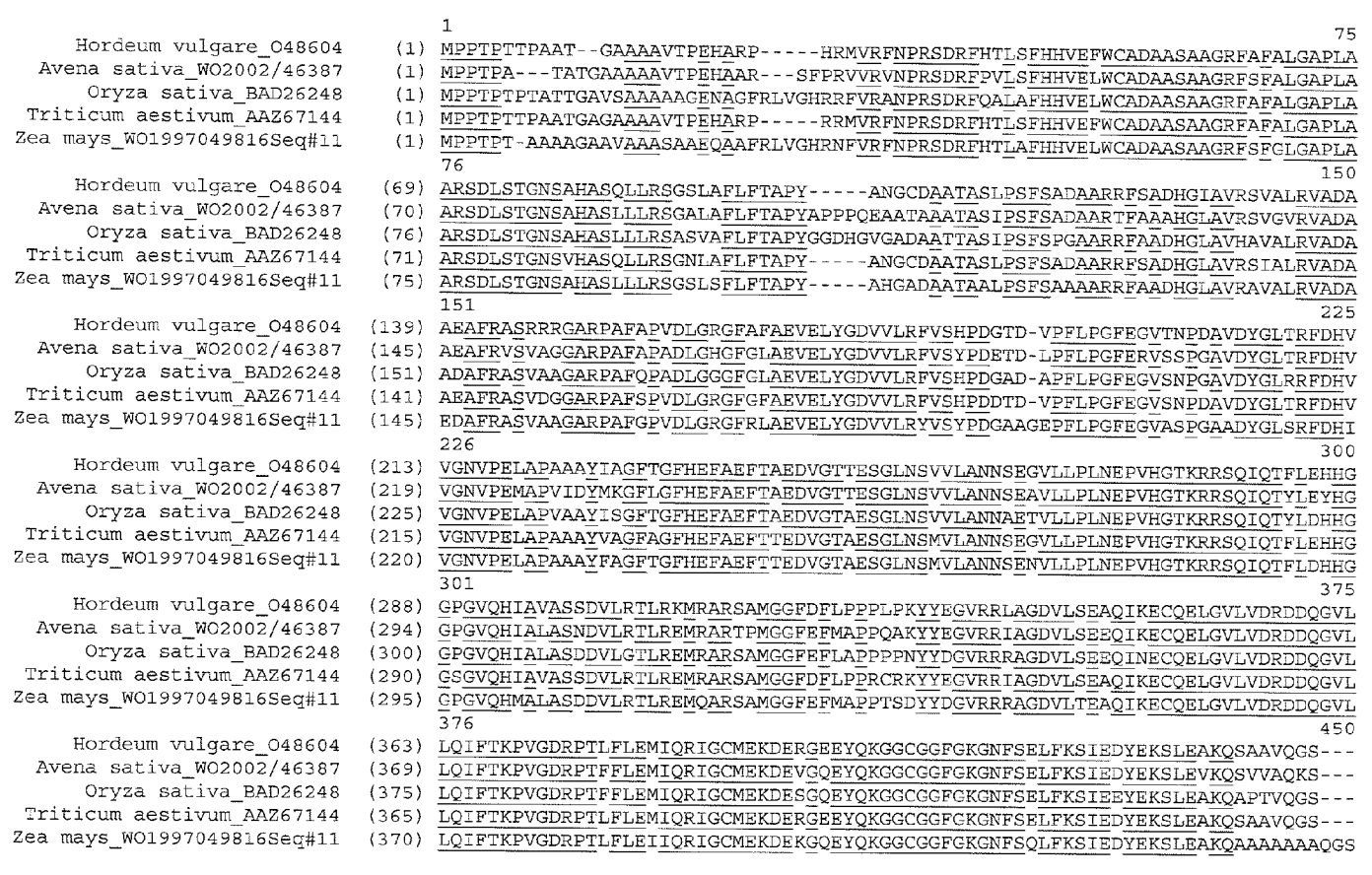
Figure 5C:
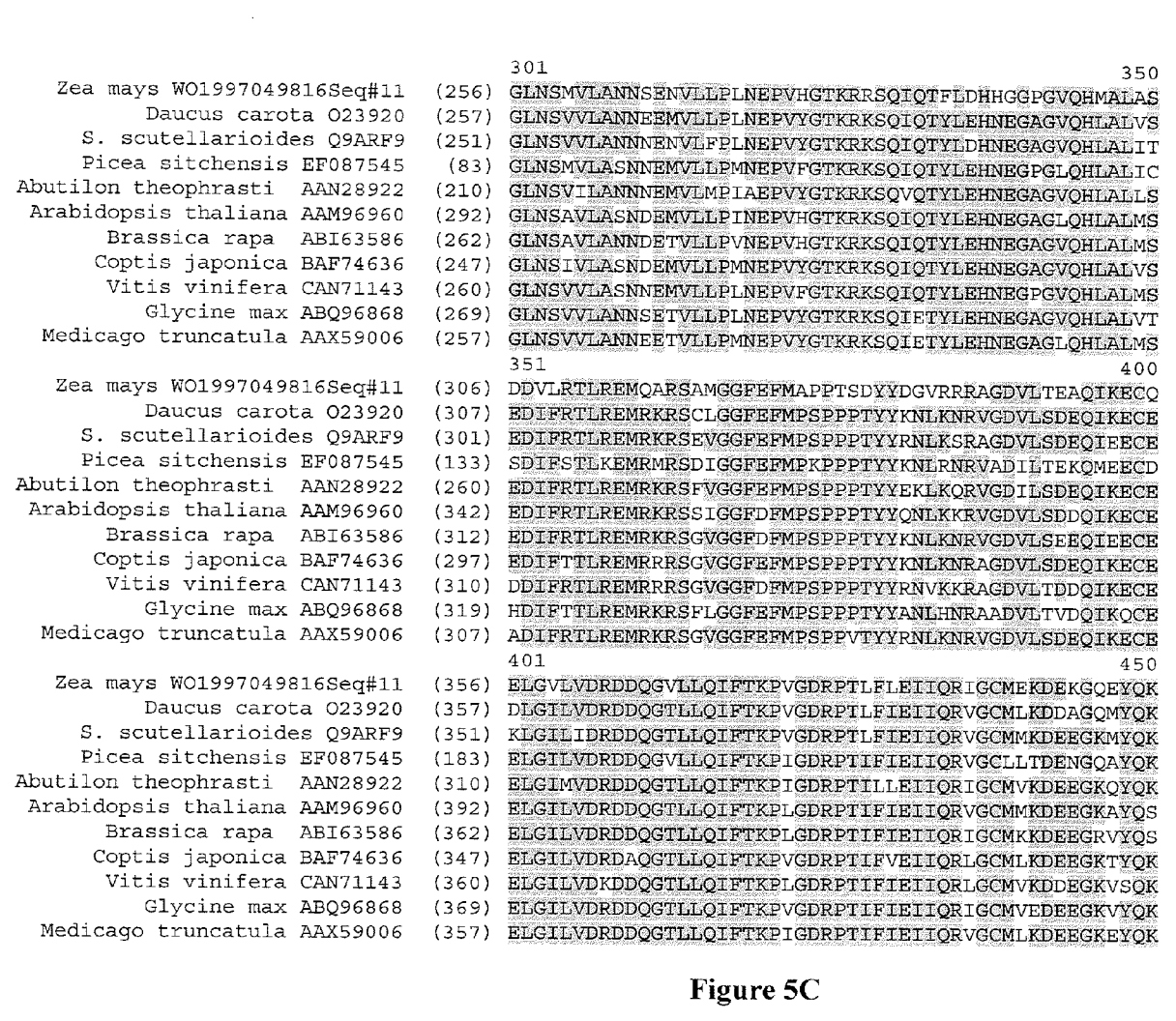
Figure 6:
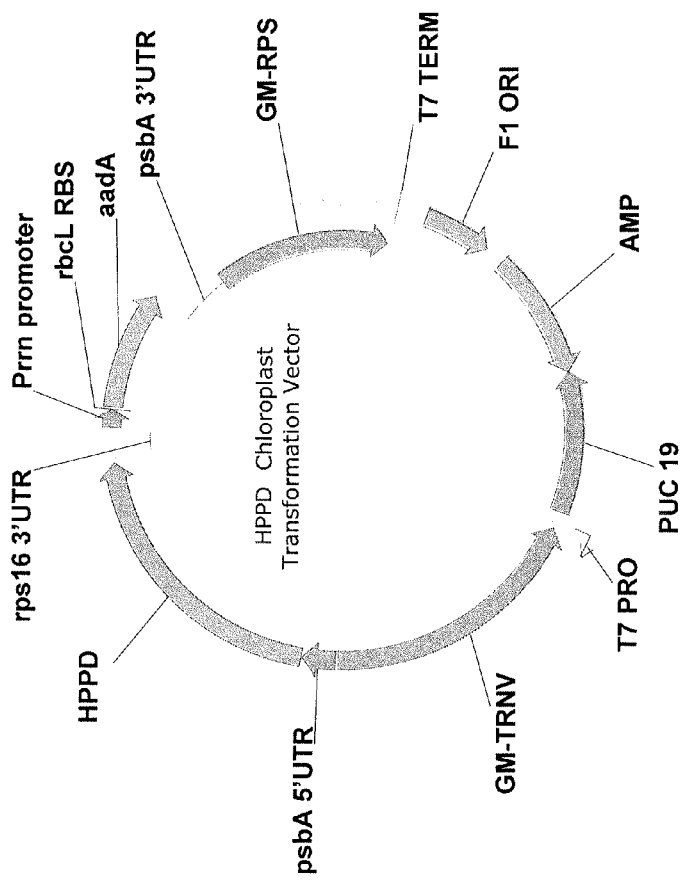
FIG. 6 provides an example of an HPPD chloroplast transformation vector.

As used herein, "Hydroxyphenylpyruvate dioxygenase" and "HPPD" "4-hydroxy phenyl pyruvate (or pyruvic acid) dioxygenase (4-HPPD)" and "p-hydroxy phenyl pyruvate (or pyruvic acid) dioxygenase (p-OHPP)" are synonymous and refer to a non-heme iron-dependent oxygenase that catalyzes the conversion of 4-hydroxyphenylpyruvate to homogentisate. See, FIG. 1. In organisms that degrade tyrosine, the reaction catalyzed by HPPD is the second step in the pathway. In plants, formation of homogentisate is necessary for the synthesis of plastoquinone, an essential redox cofactor, and tocopherol. The structures of various HPPD polypeptides are known. See, for example, FIG. 4 which provides the phylogenetic diversity of several monocot HPPD polypeptides, including sequences from *Hordeum vulgare*, *Avena sativa*, *Oryza sativa*, *Triticum aestivum*, and *Zea mays*. FIG. 5 provides the phylogenetic diversity of several dicot HPPD polypeptides including *Daucus carota*, *Solenosteman sautellarioides*, *Picea Sitchensis*, *Abutilon theophrasti*, *Arabidopsis thaliana*, *Brassica rapa*, *Coptis japonica*, *Vitis vinifera*, *Glycine max*, and *Medicago truncatula*.

Various methods and compositions are provided which employ polynucleotides and polypeptides having HPPD activity and having an increased insensitivity to at least one HPPD inhibitor when compared to an appropriate control. Such HPPD polypeptides include those set forth in any one of SEQ ID NO: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 383, 384, 385, 386, 387, 388, 389, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 453, 454, 455, 456, 457, 458, or 549 and biologically active variants and fragments thereof. Further provided are the polynucleotides encoding these various polypeptides and active variant and fragments thereof.

Further provided are novel classes of HPPD polypeptides and polynucleotides encoding the same. Specifically, HPPD polypeptides, and polynucleotides encoding the same, are provided which comprise at least one or more motif as set forth in SEQ ID NOS: 372, 373, 374, 375, 376, 377, 378, 379, 380, 382, 460, 461, 462, and/or 463. See, also Table 18 in Example 16. In specific embodiments, HPPD polypeptides, and polynucleotides encoding the same, are provided wherein the sequences comprise at least one of the HPPD motifs set forth in any of SEQ ID NOS: 372, 373, 374, 375, 376, 377, 378, 379, 380, 382, 460, 461, 462, 463, 467, 468-489 or any combination thereof where said sequence further comprises or encodes an HPPD sequence having at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% sequence identity to a native HPPD polypeptide, including for example, a native HPPD from a bacteria, plant, fungus, insect or mammal including, for example, any one of SEQ ID NO: 1, 2, 328, 329, 330, 331, 332, 333, 334, 335, 336, 337, 338, 339, 340, 327, 391, 392, 394, 396, 465, 467-489.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 414 of SEQ ID NO:1 comprises a lysine, arginine, histidine, or alanine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396, or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 341 of SEQ ID NO:1 comprises a cysteine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 341 of SEQ ID NO:1 comprises a cysteine and the encoded polypeptide comprises at least one of the following amino acid residues: the amino acid residue corresponding to amino acid position 261 of SEQ ID NO:1 comprises an alanine, the amino acid residue corresponding to amino acid position 301 of SEQ ID NO:1 comprises an isoleucine, the amino acid residue corresponding to amino acid position 327 of SEQ ID NO:1 comprises a leucine, the amino acid residue corresponding to amino acid position 328 of SEQ ID NO:1 comprises a proline, the amino acid residue corresponding to amino acid position 360 of SEQ ID NO:1 comprises a methionine, and/or the amino acid residue corresponding to amino acid position 417 of SEQ ID NO:1 comprises a glycine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 341 of SEQ ID NO:1 comprises a glutamic acid and the encoded polypeptide comprises at least one of the following amino acid residues: the amino acid residue corresponding to amino acid position 328 of SEQ ID NO:1 comprises a proline, the amino acid residue corresponding to amino acid position 360 of SEQ ID NO:1 comprises a methionine, and/or the amino acid residue corresponding to amino acid position 417 of SEQ ID NO:1 comprises a glycine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 417 of SEQ ID NO:1 comprises a glycine and the polypeptide comprises at least one of the following amino acid residues: the amino acid position corresponding to amino acid 327 of SEQ ID NO:1 comprises a leucine, the amino acid position corresponding to amino acid 331 of SEQ ID NO:1 comprises a proline, and/or the amino acid position corresponding to amino acid 360 of SEQ ID NO:1 comprises a methionine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 261 of SEQ ID NO:1 comprises an alanine and/or that corresponds to amino acid position 301 of SEQ ID NO:1 comprises a isoleucine; and the amino acid residue corresponding to amino acid position 328 of SEQ ID NO:1 comprises a proline and the encoded polypeptide comprises at least one of the following amino acid residues: the amino acid residue corresponding to amino acid position 360 of SEQ ID NO:1 comprises a methionine or the amino acid residue corresponding to amino acid position 417 of SEQ ID NO:1 comprises a glycine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 261 of SEQ ID NO:1 comprises an alanine and/or amino acid position 327 of SEQ ID NO:1 comprises a leucine; and the amino acid corresponding to amino acid position 331 of SEQ ID NO:1 comprises a proline and the amino acid corresponding to amino acid position 341 of SEQ ID NO:1 comprises a glutamic acid. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 209 of SEQ ID NO:1 comprises a valine and amino acid position 233 of SEQ ID NO:1 comprises a leucine; and the encoded polypeptide comprises at least one of the following amino acid residues: the amino acid residue corresponding to amino acid position 301 of SEQ ID NO:1 comprises a isoleucine and the amino acid residue corresponding to amino acid position 327 of SEQ ID NO:1 comprises a leucine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396 or 465.

Further provided are HPPD polypeptides, and polynucleotides encoding the same, wherein the polypeptide has HPPD activity and displays insensitivity to an HPPD inhibitor, and wherein the amino acid residue in the polypeptide that corresponds to amino acid position 327 of SEQ ID NO:1 comprises a leucine and amino acid position 328 of SEQ ID NO:1 comprises a proline; and the polypeptide comprises at least one of the following amino acid residues: the amino acid residue corresponding to amino acid position 233 of SEQ ID NO:1 comprises a leucine and the amino acid residue corresponding to amino acid position 360 of SEQ ID NO:1 comprises a methionine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396, or 465.

Further provided are HPPD polypeptides, and polynucleotides encoding the same, wherein the polypeptide has HPPD activity and displays insensitivity to an HPPD inhibitor, and wherein said HPPD polypeptide comprises at least 1, 2, 3, 4, 5 or 6 of any of the following amino acids: the amino acid residue in the encoded polypeptide that corresponds to amino acid position 44 of SEQ ID NO:1 comprises a glutamine, isoleucine, cysteine, serine, glycine or valine; amino acid position 233 of SEQ ID NO:1 comprises a methionine, cysteine, leucine, isoleucine or valine; the amino acid residue corresponding to amino acid position 316 of SEQ ID NO:1 comprises a glutamine, lysine or arginine; the amino acid residue corresponding to amino acid position 331 of SEQ ID NO:1 comprises a leucine, glycine, glutamine or histidine; the amino acid residue corresponding to amino acid position 341 of SEQ ID NO:1 comprises a cysteine, aspartate or alanine, and/or the amino acid residue corresponding to amino acid position 360 of SEQ ID NO:1 comprises a methionine or leucine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396, 465, 3-164, 383-389, 165-326, 397-457.

In yet other embodiments, HPPD polypeptides, and polynucleotides encoding the same, are provided wherein the polypeptide has HPPD activity and displays insensitivity to an HPPD inhibitor, and wherein said HPPD polypeptide comprises at least 1, 2, 3, 4, 5 or 6 of any of the following amino acids: the amino acid residue in the encoded polypeptide that corresponds to amino acid position 44 of SEQ ID NO:1 comprises a histidine, glutamine, isoleucine, cysteine, serine, glycine or valine; amino acid position 233 of SEQ ID NO:1 comprises a phenylalanine, methionine, cysteine, leucine, isoleucine or valine; the amino acid residue corresponding to amino acid position 316 of SEQ ID NO:1 comprises a glutamine, lysine or arginine; the amino acid residue corresponding to amino acid position 331 of SEQ ID NO:1 comprises a threonine, leucine, glycine, glutamine or histidine; the amino acid residue corresponding to amino acid position 341 of SEQ ID NO:1 comprises a arginine, cysteine, aspartate or alanine, and/or the amino acid residue corresponding to amino acid position 360 of SEQ ID NO:1 comprises a methionine, lysine, or leucine. In still further embodiments, the HPPD polypeptide further comprises at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% to any one of SEQ ID NOS: 1, 2, 328, 329, 330, 331, 332, 333, 334, 335, 336, 337, 338, 339, 340, 327, 391, 392, 394, 396, 465, 3-164, 383-389, 165-326, 397-457.

As used herein, an "isolated" or "purified" polynucleotide or polypeptide, or biologically active portion thereof, is substantially or essentially free from components that normally accompany or interact with the polynucleotide or polypeptide as found in its naturally occurring environment. Thus, an isolated or purified polynucleotide or polypeptide is substantially free of other cellular material or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A polypeptide that is substantially free of cellular material includes preparations of polypeptides having less than about 30%, 20%, 10%, 5%, or 1% (by dry weight) of contaminating protein. When the polypeptide of the invention or biologically active portion thereof is recombinantly produced, optimally culture medium represents less than about 30%, 20%, 10%, 5%, or 1% (by dry weight) of chemical precursors or non-protein-of-interest chemicals.

As used herein, polynucleotide or polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A polypeptide expressed in vitro or in vivo from a recombinant polynucleotide is an example of a recombinant polypeptide. Likewise, a polynucleotide sequence that does not appear in nature, for example, a variant of a naturally occurring gene is recombinant.

A "control" or "control plant" or "control plant cell" provides a reference point for measuring changes in phenotype of the subject plant or plant cell, and may be any suitable plant or plant cell. A control plant or plant cell may comprise, for example: (a) a wild-type or native plant or cell, i.e., of the same genotype as the starting material for the genetic alteration which resulted in the subject plant or cell; (b) a plant or plant cell of the same genotype as the starting material but which has been transformed with a null construct (i.e., with a construct which has no known effect on the trait of interest, such as a construct comprising a marker gene); (c) a plant or plant cell which is a non-transformed segregant among progeny of a subject plant or plant cell; (d) a plant or plant cell which is genetically identical to the subject plant or plant cell but which is not exposed to the same treatment (e.g., herbicide treatment) as the subject plant or plant cell; or (e) the subject plant or plant cell itself, under conditions in which the gene of interest is not expressed.

i. Hydroxyphenylpyruvate Dioxygenase Activity

As used herein, "hydroxyphenylpyruvate dioxygenase activity" or "HPPD activity" refers to the conversion of 4-hydroxyphenylpyruvate to homogentisate. As used herein, a polypeptide having "HPPD activity" comprises an HPPD polypeptide or an active variant or fragment thereof that retains sufficient HPPD activity such that (i) when expressed at sufficient levels in a cell that requires HPPD activity for viability, the HPPD polypeptide or active variant or fragment exhibits sufficient HPPD activity to maintain viability of the cell in which it is expressed; or (ii) when expressed in a cell that requires HPPD activity for viability, the HPPD polypeptide or active variant or fragment thereof, when expressed in combination with one or more additional HPPD polypeptides results in the viability of the cell. In one embodiment, the HPPD activity of an HPPD polypeptide or an active variant or fragment thereof is such that in the absence of an HPPD inhibitor said polypeptide or active variant or fragment thereof displays at least about 5%, 15%, 20%, 25%, 30%, 35%, 40%, 45%, 50%, 55%, 60%, 65%, 70%, 75%, 80%, 85%, 90%, or 95% or greater of the HPPD activity displayed in a native HPPD polypeptide (i.e, in any one of SEQ ID NO: 2, 328, 329, 330, 331, 332, 333, 334, 335, 336, 337, 338, 339, 340, 327, 391, 392, 394, or 396.) Methods to determine such kinetic parameters (i.e., $K_m$, $k_{cat}$, $k_{cat}/K_m$) are known and discussed elsewhere herein.

In still further embodiments, the HPPD polypeptide or active variant or fragment thereof has an activity that is at least equivalent to a native HPPD polypeptide or has an activity that is increased when compared to a native HPPD polypeptide. An "equivalent" HPPD activity refers to an activity level that is not statistically significantly different from the control as determined through any enzymatic kinetic parameter, including for example, via $K_m$, $k_{cat}$, or $k_{cat}/K_m$. An increased HPPD activity comprises any statistically significant increase in HPPD activity as determined through any enzymatic kinetic parameter, such as, for example, $K_m$, $k_{cat}$, or $k_{cat}/K_m$. In specific embodiments, an increase in HPPD activity comprises at least a 1.1, 1.2, 1.3, 1.4, 1.5, 1.6, 1.7, 1.8, 2, 3, 4, 5, 6, 7, 8, 9, or 10 fold or greater improvement in a given kinetic parameter when compared to the maize wild-type HPPD sequence as set forth in SEQ ID NO:1 or when compared to a native HPPD polypeptide. Methods to determine such kinetic parameters are known.

Briefly, HPPD catalyzes the conversion of 4-hydroxyphenylpyruvate (HPP) to homogentisate. Substrate and product do not differ in absorbance of light at any useful wavelength. However, homogentisate dioxygenase (HGD) catalyzes the conversion of homogentisate into maleylacetoacetate which absorbs strongly at 320 nm. Thus, by combining 4-hydroxyphenylpyruvate with both HPPD and HGD under the appropriate reaction conditions HPPD activity can be assayed.

As used herein, a "native" HPPD polypeptide comprises any wild-type HPPD sequence. Such sequences are known in the art and representative native/wild-type HPPD sequences from various monocot and dicot plants are set forth in FIGS. 4 and 5 and 9 and in SEQ ID NO: 1, 2, 328, 329, 330, 331, 332, 333, 334, 335, 336, 337, 338, 339, 340, 327, 391, 392, 394, or 396. In specific embodiments, the biologically active fragments and variants of the HPPD sequences is compared to the maize wild-type HPPD polypeptide (SEQ ID NO:1) or to a native HPPD polypeptide.

As used herein, a "corresponding native" HPPD polypeptide comprises the native or wild type sequence from which the biologically active variant is derived. For example, for a biologically active variant or fragment of a soy HPPD polypeptide, the corresponding native HPPD polypeptide would be the native soy sequence as set forth in SEQ ID NO:2. Similarly, for a biologically active variant or fragment of a rice HPPD polypeptide, the corresponding native HPPD polypeptide would be the native rice sequence as set forth in SEQ ID NO:330.

ii. Insensitivity to HPPD Inhibitors

In order to provide plants with tolerance to commercially useful application rates of at least one desired HPPD inhibitor, it is advantageous to use polynucleotides which encode HPPD polypeptides having sufficient HPPD activity and having an insensitivity to inhibition by at least one or more HPPD inhibitor. Thus, in specific embodiments, the HPPD polynucleotides and polypeptides and active variants and fragments thereof provided herein display an increased insensitivity to an HPPD inhibitor when compared to a corresponding native HPPD polypeptide and/or an increased insensitivity when compared to the maize native HPPD polypeptide (SEQ ID NO: 1).

As used herein, an "HPPD inhibitor" comprises any compound or combinations of compounds which decrease the ability of HPPD to catalyze the conversion of 4-hydroxyphenylpyruvate to homogentisate. In specific embodiments, the HPPD inhibitor comprises a herbicidal inhibitor of HPPD. Non-limiting examples of HPPD inhibitors include, triketones (such as, mesotrione, sulcotrione, topramezone, and tembotrione); isoxazoles (such as, pyrasulfotole and isoxaflutole); pyrazoles (such as, benzofenap, pyrazoxyfen, and pyrazolynate); and benzobicyclon. Agriculturally acceptable salts of the various inhibitors include salts, the cations or anions of which are known and accepted in the art for the formation of salts for agricultural or horticultural use. See, for example, WO2005/053407 herein incorporated by reference.

An "increased" or an "improved" insensitivity are used interchangeably herein. An "increased" or an "improved" insensitivity to an HPPD inhibitor comprises any statistically significant increase in the insensitivity of the HPPD polypeptide to the inhibitor as determined through any enzymatic kinetic parameter, such as, for example, the dissociation constant ($K_D$) of the enzyme-inhibitor complex, the rates of association ($k_{ON}$), or dissociation ($k_{OFF}$) of inhibitor with or from enzyme, or the ratio of $k_{OFF}/k_{ON}$. This invention additionally defines novel parameters, "ON rate ratio", "OFF rate ratio", and "insensitivity parameter" that are not direct measurements of on and off rates but are measurements of the effect of the on and off rates inherent to a particular HPPD enzyme on its catalytic function when the enzyme is exposed to the inhibitor. An improvement in insensitivity need not show an improvement in all kinetic parameters. The improvement of a single kinetic parameter or any combination thereof is sufficient to classify the change as an improvement in insensitivity. In specific embodiments, the increased insensitivity to the HPPD inhibitor is determined by measuring these novel insensitivity parameters of the enzyme. Thus, in specific embodiments, the increased insensitivity to an HPPD inhibitor comprises at least a 0.2, 0.3, 0.5, 0.7, 0.9, 1, 2, 3, 4, 5, 6, 7, 8, 9, 10, 11, 12, 13, 14, 15, 16, 17, 18, 19, 20, 30, 40, 50, 60, 70 fold or greater improvement in a given kinetic parameter when compared to a native HPPD polypeptide and/or when compared to the maize wild-type HPPD sequence as set forth in SEQ ID NO:1.

In specific embodiments, an improved insensitivity to an HPPD inhibitor comprises (a) a slower rate of association of enzyme and inhibitor as quantified, for example, by a higher ON rate ratio than native HPPD; (b) a faster rate of dissociation of inhibitor from enzyme as quantified, for example, by a higher OFF rate ratio than native HPPD; and/or (c) both a slower rate of association of inhibitor with enzyme and a faster rate of dissociation of inhibitor from enzyme as quantified, for example, by a higher product of ON rate ratio and OFF rate ratio than native HPPD.

Methods to determine kinetic parameters for measuring the insensitivity of HPPD to an inhibitor are known. See also, Examples 1, 4, 5, and 7-11. Briefly, herbicidal inhibitors of HPPD form a tight complex with the enzyme by the dual mechanisms of coordination to the active site iron atom through a pair of keto oxygens and a Pi stack of the aromatic ring of the inhibitor between a pair of active site phenylalanines. As a result, conventional $I_{50}$ determinations are not able to distinguish differences in binding affinity among various forms of HPPD and the inhibitor. All values will be the same, namely, 50% of the enzyme concentration. To devise a parameter for detecting changes in inhibitor binding affinity, $K_D$, one can utilize the relationship between $K_D$ and the rates of binding and release of inhibitor (I) to and from the enzyme (E).

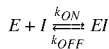

$$E + I \underset{k_{OFF}}{\overset{k_{ON}}{\rightleftharpoons}} EI$$

At equilibrium, rates of binding and release are equal. Thus, $$k_{ON}[E][I]=k_{OFF}[EI]$$

Written as a dissociation (products over reactants), the equation can be re-arranged to:

$$\frac{[E][I]}{[EI]} = \frac{k_{OFF}}{k_{ON}} = K_D$$

Higher $K_D$ (reduced affinity or increased insensitivity) can be attained with a numerically smaller ON rate, a larger OFF rate or both. To detect changes in ON and OFF rates, one can observe the time course of an HPPD reaction as inhibitor binds to and inactivates the enzyme (ON rate), or is released from a pre-formed enzyme-inhibitor complex (OFF rate). See, for example, Example 1.

A quantitative indicator of ON rate can be obtained by monitoring the time courses of HPPD reactions in the presence and absence of inhibitor (e.g. mesotrione). The ratio of the reaction rate with inhibitor to that without inhibitor during the 70 to 90 second interval of the reaction is the "ON rate ratio".

A quantitative indicator of OFF rate can be obtained by observing the time course of an HPPD reaction as the HPPD inhibitor (such as mesotrione) is released from a pre-formed enzyme-inhibitor complex. Reaction velocity accelerates as inhibitor is released from the enzyme until a steady state is reached, during which the reaction velocity is constant. The ratio of the steady state rate in mixtures containing mesotrione (or other herbicidal inhibitor) to the initial velocity of mixtures lacking inhibitor is termed the "OFF rate ratio". Another parameter to record is the time span required for the reactions with inhibitor to reach the steady state. In still further embodiments, to be sure that improvement in ON rates is being taken into account, the ON and OFF rate ratios are multiplied together and the product is termed the "insensitivity parameter".

The increased insensitivity of an HPPD inhibitor can also be determined by assaying the increased insensitivity of a cell, a plant, a plant cell expressing said HPPD polypeptide or active fragment or variant thereof. In such instances, the cell, plant, or plant cell expressing an HPPD sequence having an increased insensitivity to an HPPD inhibitor will display an increased tolerance to the HPPD inhibitor or to a combination of HPPD inhibitors when compared to a control cell, plant or plant cell not expressing the HPPD sequence. "Increased tolerance" to a herbicide is demonstrated when plants which display the increased tolerance to a herbicide are subjected to the HPPD inhibitor and a dose/response curve is shifted to the right when compared with that provided by an appropriate control plant. Such dose/response curves have "dose" plotted on the x-axis and "percentage injury", "herbicidal effect" etc. plotted on the y-axis. Plants which are substantially "resistant" or "tolerant" to the herbicide exhibit few, if any, bleached, necrotic, lytic, chlorotic or other lesions and are not stunted, wilted or deformed when subjected to the herbicide at concentrations and rates which are typically employed by the agricultural community to kill weeds in the field.

For example, a plant expressing an HPPD polypeptide which displays an increased insensitivity to an HPPD inhibitor will tolerate statistically significantly higher levels of the HPPD inhibitor than a control plant not expressing the HPPD polypeptide. In specific embodiments, plant expressing the HPPD sequences disclosed herein and the active variants and fragments thereof allow for an increased insensitivity to an HPPD inhibitor comprising, for example, at least a 2, 3, 4, 5, 6, 7, 8, 9, 10, 11, 12, 13, 14, 15, 16, 17, 18, 19, 20, 100 fold or greater increase in a given performance parameter when compared to untransformed plants. See, also, Examples 9, 10 and 11 for exemplary assays.

Different HPPD polypeptides can provide different levels of tolerance to different HPPD-inhibitor herbicides. While a given HPPD polypeptide may provide a useful level of tolerance to some HPPD-inhibitor herbicides it may be quite inadequate to provide commercial levels of tolerance to a different HPPD-inhibitor herbicide which, for example, may control a different spectrum of weeds, be cheaper to make or offer environmental benefits. Thus, the various HPPD polypeptides disclosed herein can be used in combination in a single plant, plant explant or plant cell to expand and/or improve the tolerance to a desired HPPD herbicide or combination of HPPD herbicides.

B. Active Fragments and Variants of HPPD Sequences

Methods and compositions are provided which employ polynucleotides and polypeptides having HPPD activity and having an insensitivity to at least one HPPD inhibitor.

i. Polynucleotide and Polypeptide Fragments

Fragments and variants of HPPD polynucleotides and polypeptides are also encompassed by the present invention. By "fragment" is intended a portion of the polynucleotide or a portion of the amino acid sequence and hence protein encoded thereby. Fragments of a polynucleotide may encode protein fragments that retain HPPD activity and HPPD inhibitor insensitivity. Alternatively, fragments of a polynucleotide that is useful as hybridization probes generally do not encode fragment proteins retaining biological activity. Thus, fragments of a nucleotide sequence may range from at least about 20 nucleotides, about 50 nucleotides, about 100 nucleotides, and up to the full-length polynucleotide encoding the HPPD polypeptides.

A fragment of an HPPD polynucleotide that encodes a biologically active portion of an HPPD protein of the invention will encode at least 50, 75, 100, 150, 175, 200, 225, 250, 275, 300, 325, 350, 375, 400, 410, 415, 420, 425, 430, 435, or 440 contiguous amino acids, or up to the total number of amino acids present in a full-length HPPD polypeptide. Fragments of an HPPD polynucleotide that are useful as hybridization probes or PCR primers generally need not encode a biologically active portion of an HPPD protein.

Thus, a fragment of an HPPD polynucleotide may encode a biologically active portion of an HPPD polypeptide, or it may be a fragment that can be used as a hybridization probe or PCR primer using methods disclosed below. A biologically active portion of an HPPD polypeptide can be prepared by isolating a portion of one of the HPPD polynucleotides, expressing the encoded portion of the HPPD polypeptides (e.g., by recombinant expression in vitro), and assessing the activity of the HPPD portion of the HPPD protein. Polynucleotides that are fragments of an HPPD nucleotide sequence comprise at least 16, 20, 50, 75, 100, 150, 200, 250, 300, 350, 400, 450, 500, 550, 600, 650, 700, 800, 900, 1,000, 1,100, 1,200, 1,300, or 1,400 contiguous nucleotides, or up to the number of nucleotides present in a full-length HPPD polynucleotide disclosed herein.

In one embodiment, the HPPD polynucleotides and/or polypeptides comprise or encode an N-terminal truncation of the HPPD polypeptide. Such active HPPD fragments comprise an N-terminal deletion of at least the first 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more amino acids of the HPPD polypeptide of any one of SEQ ID NO: 1-164 and 383-389, 404-430 and/or 458-459. In specific embodiments, such N-terminal deletions are designed to comprise a methionine residue on the N-terminus. In specific embodiments, a fragment of the HPPD polypeptide or polynucleotide comprising or encoding the N-terminal truncated HPPD polypeptide comprises or encodes a polypeptide having a deletion of amino acids 2-23 of any one of SEQ ID NOS: 1-164, 404-430 and/or 458-459. Such N-terminal truncations are set forth in SEQ ID NOS: 165-326, 397-403 and/or 431-457.

ii. Polynucleotide and Polypeptide Variants

"Variant" protein is intended to mean a protein derived from the protein by deletion (i.e., truncation at the 5' and/or 3' end) and/or a deletion or addition of one or more amino acids at one or more internal sites in the native protein and/or substitution of one or more amino acids at one or more sites in the native protein. Variant proteins encompassed are biologically active, that is they continue to possess the desired biological activity of the native protein, that is, have HPPD activity and/or display insensitivity to a HPPD inhibitor as described herein. Such variants may result from, for example, genetic polymorphism or from human manipulation.

"Variants" is intended to mean substantially similar sequences. For polynucleotides, a variant comprises a polynucleotide having a deletion (i.e., truncations) at the 5' and/or 3' end and/or a deletion and/or addition of one or more nucleotides at one or more internal sites within the native polynucleotide and/or a substitution of one or more nucleotides at one or more sites in the native polynucleotide. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of one of the HPPD polypeptides of the invention. Naturally occurring variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis or gene synthesis but which still encode an HPPD polypeptide.

Biologically active variants of an HPPD polypeptide (and the polynucleotide encoding the same) will have at least about 90%, 91%, 92%, 93%, 94%, 95%, 95.5%, 95.7%, 95.9%, 96%, 96.3%, 96.5%, 96.9%, 97%, 97.3%, 97.5%, 97.9%, 98%, 98.3%, 98.5%, 98.9%, 99%, 99.3%, 99.5%, 99.6% or more sequence identity to the polypeptide of any one of SEQ ID NO: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 383, 384, 385, 386, 387, 388, 389, 404, 405, 406, 407, 408, 409, 410, 411, 412, 413, 414, 415, 416, 417, 418, 419, 420, 421, 422, 423, 424, 425, 426, 427, 428, 429, 430, 458, or 459 or with regard to any of the HPPD polypeptides having the various HPPD motifs disclosed herein as determined by sequence alignment programs and parameters described elsewhere herein.

In specific embodiments, the biologically active polypeptide variants have (1) at least 96% sequence identity to the full length SEQ ID NO: 90; (2) at least 98.5% sequence identity to SEQ ID NO:158; (3) at least 98.7% sequence identity to the full length sequence set forth in SEQ ID NO:103 or 104; (4) at least 99.2% sequence identity to the full length sequence set forth in SEQ ID NO:163; or (5) at least 96.7% sequence identity to the full length sequence set forth in SEQ ID NO: 383; wherein the percent identity is determined using a BLAST alignment used the BLOSUM62 substitution matrix, a gap existence penalty of 11, and a gap extension penalty of 1.

In other embodiments, variants of a HPPD polypeptides (and polynucleotide encoding the same) will have at least about 90%, 91%, 92%, 93%, 94%, 95%, 95.5%, 95.7%, 95.9%, 96%, 96.3%, 96.5%, 96.9%, 97%, 97.3%, 97.5%, 97.9%, 98%, 98.3%, 98.5%, 98.9%, 99%, 99.3%, 99.5% or more sequence identity to an HPPD polypeptide having an N-terminal deletion. For example, such polypeptides comprise an N-terminal truncation of any one of SEQ ID NO: 1-164 and/or 383-389, 404-430 and/or 458-459 comprising an N-terminal deletion of at least the first 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 amino acids wherein said active variant of the HPPD polypeptide comprises at least 90%, 91%, 92%, 93%, 94%, 95%, 95.5%, 95.7%, 95.9%, 96%, 96.3%, 96.5%, 96.9%, 97%, 97.3%, 97.5%, 97.9%, 98%, 98.3%, 98.5%, 98.9%, 99%, 99.3%, 99.5% or more sequence identity to an N-terminal deletion of the HPPD polypeptide. In further embodiments, the N-terminal truncates further comprise a methionine amino acid residue on the N-terminus. In specific embodiments, fragments of the HPPD polypeptide have a deletion of amino acids 2-23 of any one of SEQ ID NOS: 1-164 and 383-389, 404-430, and 458-459. Such polypeptides are set forth in SEQ ID NOS: 165-326 and 397-403 and 431-457. Thus, further provided are HPPD polypeptide comprising at least 90%, 91%, 92%, 93%, 94%, 95%, 95.5%, 95.7%, 95.9%, 96%, 96.3%, 96.5%, 96.9%, 97%, 97.3%, 97.5%, 97.9%, 98%, 98.3%, 98.5%, 98.9%, 99%, 99.3%, 99.5% or more sequence identity to the amino acid sequence set forth in any one of SEQ ID NO: 165-326 and 397-403 and 431-457.

In specific embodiments, the biologically active variant polypeptide (and polynucleotide encoding the same) have (1) at least 97% sequence identity to the full length SEQ ID NO: 250 or 246; (2) at least 98.7% sequence identity to SEQ ID NO:320; (3) at least 99.1% sequence identity to the full length sequence set forth in SEQ ID NO:265, 266, or 277, (4) at least 99.6% sequence identity to the full length sequence set forth in SEQ ID NO:324 or 325; or (6) at least 99.9% sequence identity to the full length sequence set forth in SEQ ID NO: 264 or 319, wherein percent identity is determined using the BLAST alignment used the BLOSUM62 substitution matrix, a gap existence penalty of 11, and a gap extension penalty of 1.

In other embodiments, variants of a particular polypeptide (and polynucleotide encoding the same) will have a bit score of at least 700, 710, 720, 721, 722, 723, 724, 725, 726, 728, 729, 730, 731, 732, 733, 734, 735, 736, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 828, 829, 830, 831, 832, 833, 834, 835, 836, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890 or greater as determined by parameters described elsewhere herein to a polypeptide of any one of SEQ ID NO: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 383, 384, 385, 386, 387, 388, 389, 404, 405, 406, 407, 408, 409, 410, 411, 412, 413, 414, 415, 416, 417, 418, 419, 420, 421, 422, 423, 424, 425, 426, 427, 428, 429, 430, 458, or 459.

In specific embodiments, the biologically active polypeptide variant (and polynucleotide encoding the same) (1) share a bit score of at least 718 with SEQ ID NO: 109; (2) share a bit score of at least 719 with SEQ ID NO: 101; (3) share a bit score of at least 722 with SEQ ID NO:50; (4) share a bit score of at least 723 with SEQ ID NO:54 or 164; (5) share a bit score of at least 735 with SEQ ID NO:131; (6) share a bit score of at least 878 with SEQ ID NO:103; or (7) share a bit score of at least 881 with SEQ ID NO:147, wherein bit score is determined employing the BLAST alignment used the BLOSUM62 substitution matrix, a gap existence penalty of 11, and a gap extension penalty of 1.

In other embodiments, variants of a particular HPPD polypeptide (and polynucleotide encoding the same) will have a bit score of at least 650, 675, 700, 710, 720, 721, 722, 723, 724, 725, 726, 728, 729, 730, 731, 732, 733, 734, 735, 736, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 828, 829, 830, 831, 832, 833, 834, 835, 836, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890 or greater to an N-terminal deletion of the HPPD polypeptide. For example, such polypeptides comprise an N-terminal truncation of any one of SEQ ID NO: 1-164 and 383-389, 404-430, and 458-459 comprising an N-terminal deletion of at least the first 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 amino acids wherein said active variant of the HPPD polypeptide comprises a bit score of at least 650, 675, 700, 710, 720, 721, 722, 723, 724, 725, 726, 728, 729, 730, 731, 732, 733, 734, 735, 736, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 828, 829, 830, 831, 832, 833, 834, 835, 836, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890 or greater to a polypeptide comprising an N-terminal deletion of the HPPD polypeptide. In further embodiments, the N-terminal truncates further comprise a methionine amino acid residue on the N-terminus. In specific embodiments, fragments of the HPPD polypeptide (and the polynucleotides encoding the same) have a deletion of amino acids 2-23. Such polypeptides are set forth in SEQ ID NO: 165-326 and 397-403 and 431-457. Thus, variants are provided which comprise a bit score of at least 650, 675, 700, 710, 720, 721, 722, 723, 724, 725, 726, 728, 729, 730, 731, 732, 733, 734, 735, 736, 738, 739, 740, 741, 742, 743, 744, 745, 746, 747, 748, 749, 750, 751, 752, 753, 754, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 828, 829, 830, 831, 832, 833, 834, 835, 836, 838, 839, 840, 841, 842, 843, 844, 845, 846, 847, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890 or greater to any one of SEQ ID NO: 165-326 and 397-403 and 431-457.

In specific embodiments, the biologically active variant polypeptides (and the polynucleotides encoding the same) (1) share a bit score of at least 710 with SEQ ID NO: 263; (2) share a bit score of at least 713 with SEQ ID NO: 212 or 218; (3) share a bit score of at least 834 with SEQ ID NO:320; (4) share a bit score of at least 842 with SEQ ID NO:322 (5) share a bit score of at least 843 with SEQ ID NO:265; or (6) share a bit score of at least 844 with SEQ ID NO:266, wherein the bit score is determined employing the BLAST alignment used the BLOSUM62 substitution matrix, a gap existence penalty of 11, and a gap extension penalty of 1.

In other embodiments, variants of a particular polypeptide (and the polynucleotides encoding the same) will have a similarity score of at least 1800, 1805, 1810, 1815, 1820, 1825, 1830, 1835, 1840, 1845, 1850, 1855, 1859, 1860, 1865, 1870, 1875, 1880, 1885, 1890, 1895, 1900, 1905, 1910, 1915, 1920, 1925, 1930, 1935, 1940, 1945, 1950, 1955, 1960, 1965, 1970, 1975, 1980, 1985, 1990, 1995, 2000, 2005, 2010, 2015, 2020, 2025, 2030, 2035, 2040, 2045, 2050, 2055, 2060, 2065, 2070, 2075, 2080, 2085, 2090, 2095, 2100, 2105, 2110, 2115, 2120, 2125, 2130, 2135, 2140, 2145, 2150, 2155, 2160, 2165, 2170, 2175, 2180, 2185, 2190, 2195, 2200, 2205, 2210, 2215, 2220, 2225, 2230, 2235, 2240, 2245, 2250, 2255, 2260, 2265, 2270, 2275, 2280, 2285, 2290, 2295 or greater as determined by parameters described elsewhere herein to a polynucleotide encoding any one of SEQ ID NO: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 383, 384, 385, 386, 387, 388, 389, 404, 405, 406, 407, 408, 409, 410, 411, 412, 413, 414, 415, 416, 417, 418, 419, 420, 421, 422, 423, 424, 425, 426, 427, 428, 429, 430, 458, or 459.

In specific embodiments, the biologically active polypeptide variants (and the polynucleotides encoding the same) (1) share a similarity score of at least 1853 with SEQ ID NO:109; (2) share a similarity score of at least 1855 with SEQ ID NO:101; (3) share a similarity score of at least 1862 with SEQ ID NO:50; (4) share a similarity score of at least 1864 with SEQ ID NO:56 or 164; (5) share a similarity score of at least 2267 with SEQ ID NO: 103; (6) share a similarity score of at least 2267 with SEQ ID NO:160; or (7) share a similarity score of at least 1855 with SEQ ID NO: 412; wherein the similarity score is determined employing the BLAST alignment used the BLOSUM62 substitution matrix, a gap existence penalty of 11, and a gap extension penalty of 1.

In other embodiments, variants of an HPPD polypeptide (and the polynucleotides encoding the same) will have a similarity score of at least 1820, 1825, 1830, 1835, 1840, 1845, 1850, 1855, 1859, 1860, 1865, 1870, 1875, 1880, 1885, 1890, 1895, 1900, 1905, 1910, 1915, 1920, 1925, 1930, 1935, 1940, 1945, 1950, 1955, 1960, 1965, 1970, 1975, 1980, 1985, 1990, 1995, 2000, 2005, 2010, 2015, 2020, 2025, 2030, 2035, 2040, 2045, 2050, 2055, 2060, 2065, 2070, 2075, 2080, 2085, 2090, 2095, 2100, 2105, 2110, 2115, 2120, 2125, 2130, 2135, 2140, 2145, 2150, 2155, 2160, 2165, 2170, 2175, 2180, 2185, 2190, 2195, 2200, 2205, 2210, 2215, 2220, 2225, 2230, 2235, 2240, 2245, 2250, 2255, 2260, 2265, 2270, 2275, 2280, 2285, 2290, 2295 or greater to a polypeptide comprising an N-terminal deletion of the HPPD polypeptide. For example, such polypeptides comprise an N-terminal truncation of any one of SEQ ID NO: 1-164 and 383-389, 404-430, and 458-459 comprising a deletion of at least of amino acids 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, wherein said active variant of the HPPD polypeptide comprises at least similarity score of at least 1800, 1805, 1810, 1815, 1820, 1825, 1830, 1835, 1840, 1845, 1850, 1855, 1859, 1860, 1865, 1870, 1875, 1880, 1885, 1890, 1895, 1900, 1905, 1910, 1915, 1920, 1925, 1930, 1935, 1940, 1945, 1950, 1955, 1960, 1965, 1970, 1975, 1980, 1985, 1990, 1995, 2000, 2005, 2010, 2015, 2020, 2025, 2030, 2035, 2040, 2045, 2050, 2055, 2060, 2065, 2070, 2075, 2080, 2085, 2090, 2095, 2100, 2105, 2110, 2115, 2120, 2125, 2130, 2135, 2140, 2145, 2150, 2155, 2160, 2165, 2170, 2175, 2180, 2185, 2190, 2195, 2200, 2205, 2210, 2215, 2220, 2225, 2230, 2235, 2240, 2245, 2250, 2255, 2260, 2265, 2270, 2275, 2280, 2285, 2290, 2295 or greater to a polypeptide comprising an N-terminal deletion of the HPPD polypeptide. In further embodiment, the N-terminal truncates further comprises a methionine amino acid residue on the N-terminus. In specific embodiments, fragments of the HPPD polypeptide have a deletion of amino acids 2-23 of any one of SEQ ID NOS: 1-164 or 383-389, 404-430, 458, and 459. Such polypeptides are set forth in SEQ ID NO: 165-326 and 397-403, and 431-457. Thus, variants are provided which comprise a similarity score of at least 1800, 1805, 1810, 1815, 1820, 1825, 1830, 1835, 1840, 1845, 1850, 1855, 1859, 1860, 1865, 1870, 1875, 1880, 1885, 1890, 1895, 1900, 1905, 1910, 1915, 1920, 1925, 1930, 1935, 1940, 1945, 1950, 1955, 1960, 1965, 1970, 1975, 1980, 1985, 1990, 1995, 2000, 2005, 2010, 2015, 2020, 2025, 2030, 2035, 2040, 2045, 2050, 2055, 2060, 2065, 2070, 2075, 2080, 2085, 2090, 2095, 2100, 2105, 2110, 2115, 2120, 2125, 2130, 2135, 2140, 2145, 2150, 2155, 2160, 2165, 2170, 2175, 2180, 2185, 2190, 2195, 2200, 2205, 2210, 2215, 2220, 2225, 2230, 2235, 2240, 2245, 2250, 2255, 2260, 2265, 2270, 2275, 2280, 2285, 2290, 2295 or greater to any one of SEQ ID NO: 165-326 and 397-403 and 431-457.

In specific embodiments, the biologically active variant polypeptides (and the polynucleotides encoding the same) (1) share a similarity score of at least 1830 with SEQ ID NO:263; (2) share a similarity score of at least 1839 with SEQ ID NO:212; (3) share a similarity score of at least 1840 with SEQ ID NO:218; (4) share a similarity score of at least 2152 with SEQ ID NO:320; (5) share a similarity score of at least 2176 with SEQ ID NO:275; (6) share a similarity score of at least 2177 with SEQ ID NO:275; or (7) share a similarity score of at least 1825 with SEQ ID NO: 433; wherein the BLAST alignment used the similarity score is determined employing the BLOSUM62 substitution matrix, a gap existence penalty of 11, and a gap extension penalty of 1.

In still further embodiments, a biologically active variant of an HPPD protein may differ from that protein by 200, 190, 180, 170, 160, 150, 140, 130, 120, 110, 100, 90, 80, 70, 60, 50, 40, 30, 25, 20, 19, 18, 17, 16 amino acid residues, as few as 1-15 amino acid residues, as few as 1-10, such as 6-10, as few as 10, 9, 8, 7, 6, 5, as few as 4, 3, 2, or even 1 amino acid residue.

The HPPD polypeptide and the active variants and fragments thereof may be altered in various ways including amino acid substitutions, deletions, truncations, and insertions. Methods for such manipulations are generally known in the art. For example, amino acid sequence variants and fragments of the HPPD proteins can be prepared by mutations in the DNA. Methods for mutagenesis and polynucleotide alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be optimal.

Obviously, the mutations that will be made in the DNA encoding the variant must not place the sequence out of reading frame and optimally will not create complementary regions that could produce secondary mRNA structure. See, EP Patent Application Publication No. 75,444.

Variant polynucleotides and proteins also encompass sequences and proteins derived from a mutagenic and recombinogenic procedure such as DNA shuffling. With such a procedure, one or more different HPPD coding sequences can be manipulated to create a new HPPD possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the HPPD sequences disclosed herein and other known HPPD genes to obtain a new gene coding for a protein with an improved property of interest, such as a decreased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

In still further embodiments, the HPPD polypeptide or active variants and fragments thereof have been modified to remove one or more sequences that are present in other proteins which are allergens. As used herein, a "matching sequence" comprises a region of 8 contiguous identical amino acids present in a known protein allergen. See, for example, Ladics (2008) *Food and Chemical Toxicology* 46: S20-S23, herein incorporated by reference. Such identified 8-amino acid sequences, however, do not necessarily have any allergenic potential or confer allergenicity. Nonetheless, to comply with established criteria governing the potential for allergenic cross-reactivity (FAO/WHO 2001, Codex 2003), the matching sequences can be altered so the resulting polypeptide no longer contains the 8 residue contiguous match. Identification of such matching sequences is done by comparing the predicted amino acid sequence of the transgene product with that of a database of known or putative protein allergens and subsequently altering the identified amino acid sequence to remove the allergenic match. The database utilized for this analysis was the AllergenOnline database of known protein allergens housed at the University of Nebraska (www.allergenonline org). It is recognized that in specific embodiments, removal of the matching sequence via substitution, deletion and/or addition of amino acids will not impact the HPPD activity or the HPPD inhibitor insensitivity of the protein when compared to an appropriate control. TAAAAGAA (amino acids 6-13 in maize wild-type HPPD SEQ ID NO:1) was changed to TATAAGAA (SEQ ID NO:370) to eliminate the 8 amino acid match to an allergen sequence in the database. Such a change does not alter the activity or insensitivity to herbicides of HPPD enzymes. See, for example, Codex Alimentarius Commission, Alinorm 03/34: Joint FAO/WHO Food Standard Programme, Codex Alimentarius Commission, Twenty-Fifth Session, Rome, Italy, Jun. 30-Jul. 5, 2003. Appendix III, Guideline for the conduct of food safety assessment of foods derived from recombinant-DNA plants, and Appendix IV, Annex of the assessment of possible allergenicity, 47-60 and FAO/WHO, 2001. Evaluation of allergenicity of genetically modified foods. Report of a Joint FAO/WHO Expert Consultation on Allergenicity of Foods Derived from Biotechnology. Jan. 22-25, 2001. Rome, Italy.

C. Chloroplast Transit Peptides

Further provided are various methods and compositions which comprise HPPD polypeptides and active variants and fragments thereof, and polynucleotides encoding the same, wherein the HPPD sequence comprises a chloroplast transit peptide. As used herein, the term "chloroplast transit peptide" will be abbreviated "CTP" and refers to the N-terminal portion of a chloroplast precursor protein that directs the latter into chloroplasts and is subsequently cleaved off by the chloroplast processing protease. When a CTP is operably linked to the N-terminus of a polypeptide, the polypeptide is translocated into the chloroplast. Removal of the CTP from a native protein reduces or abolishes the ability of the native protein from being transported into the chloroplast. An operably linked chloroplast transit peptide is found at the N-terminus of the protein to be targeted to the chloroplast and is located upstream and immediately adjacent to the transit peptide cleavage site that separates the transit peptide from the mature protein to be targeted to the chloroplast.

The term "chloroplast transit peptide cleavage site" refers to a site between two amino acids in a chloroplast-targeting sequence at which the chloroplast processing protease acts. Chloroplast transit peptides target the desired protein to the chloroplast and can facilitate the proteins translocation into the organelle. This is accompanied by the cleavage of the transit peptide from the mature polypeptide or protein at the appropriate transit peptide cleavage site by a chloroplast processing protease, native to the chloroplast. Accordingly, a chloroplast transit peptide further comprises a suitable cleavage site for the correct processing of the pre-protein to the mature polypeptide contained within the chloroplast.

As used herein, a "heterologous" CTP comprises a transit peptide sequence which is foreign to the polypeptide it is operably linked to. In one embodiment, the heterologous chloroplast transit peptide comprises the chloroplast transit peptide found on the wild-type maize HPPD of SEQ ID NO:1. Thus, in specific embodiments, the heterologous chloroplast transit peptide comprises amino acids 1-10 of SEQ ID NO:1, amino acids 1-15 of SEQ ID NO:1, amino acids 1-20 of SEQ ID NO:1, amino acids 1-23 of SEQ ID NO:1, amino acids 1-25 of SEQ ID NO:1, amino acids 1-30 of SEQ ID NO:1, amino acids 1-35 if SEQ ID NO:1, amino acids 1-35 of SEQ ID NO:1, amino acids 1-40 of SEQ ID NO:1, amino acids 1-45 of SEQ ID NO:1, or amino acids 1-50 of SEQ ID NO:1 (SEQ ID NO: 490), or a biologically active variant or fragment of the chloroplast transit peptide. In other embodiments, the chloroplast transit peptide comprises at least the first 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 or more amino acids of SEQ ID NO:1. SEQ ID NO: 371 (MGPTPTAAAA-GAAVAAASAAEQA) comprises the first 23 amino acids of the maize HPPD polypeptide. SEQ ID NO: 490 comprises the first 50 amino acids of the maize HPPD polypeptide. In further embodiments, active variants of SEQ ID NO: 371 or 490 can be employed, wherein the variants retain the ability to target the protein to which they are operably linked to the chloroplast. Such variants can comprise polypeptides (and the polynucleotide encoding the same) comprising at least 85%, 86%, 87%, 88%, 89%, 90%, 91%, 92%, 93%, 94%, 95%, 96%, 97%, 98%, 99% or greater sequence identity to SEQ ID NO: 371 or 490.

In another embodiment, the heterologous chloroplast transit peptide comprises the chloroplast transit peptide found on the wild-type soy HPPD of SEQ ID NO:465. Thus, in specific embodiments, the heterologous chloroplast transit peptide comprises amino acids 1-10 of SEQ ID NO:465, amino acids 1-15 of SEQ ID NO:465, amino acids 1-20 of SEQ ID NO:465, amino acids 1-23 of SEQ ID NO:465, amino acids 1-25 of SEQ ID NO:465, amino acids 1-30 of SEQ ID NO:465, amino acids 1-35 if SEQ ID NO:465, amino acids 1-35 of SEQ ID NO:465, amino acids 1-40 of SEQ ID NO:465, amino acids 1-45 of SEQ ID NO:465, amino acids 1-50 of SEQ ID NO:465, amino acids 1-60 of SEQ ID NO:465, amino acids 1-70 of SEQ ID NO:465, amino acids 1-80 of SEQ ID NO:465, or a biologically active variant or fragment of the chloroplast transit peptide. In other embodiments, the chloroplast transit peptide comprises at least the first 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85 or more amino acids of SEQ ID NO:465. In further embodiments, active variants of the CTP from SEQ ID NO: 465 can be employed, wherein the variants retain the ability to target the protein to which they are operably linked to the chloroplast. Such variants can comprise polypeptides (and the polynucleotide encoding the same) comprising at least 85%, 86%, 87%, 88%, 89%, 90%, 91%, 92%, 93%, 94%, 95%, 96%, 97%, 98%, 99% or greater sequence identity to the CTP of SEQ ID NO:465.

Thus, any one of the polypeptides, or the polynucleotide encoding the same, or active variants and fragments thereof set forth in any one of SEQ ID NO:2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169. 170, 171, 172, 173, 174, 175, 176, 177, 178, 179, 180, 181, 182, 183, 184, 185, 186, 187, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 383, 384, 385, 386, 387, 388, 389, 397, 398, 399, 400, 401, 402, or 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 453, 454, 455, 456, 457, 458, or 549, can comprise a heterologous CTP sequence. Further any one of the HPPD polypeptides or polynucleotide encoding an HPPD with at least one of the HPPD motifs set forth in Table 18 (i.e., SEQ ID NOS: 372-382 and/or 460-463) or any one of other variants disclosed herein, such as those in Example 16, 18 and 20, can comprise a heterologous CTP sequence. Additional CTPs from HPPD polypeptides can be employed. See, for example, U.S. Utility application Ser. No. 13/208,960, entitled "Methods and Compositions for Targeting Sequences of Interest to a Chloroplast" filed concurrently herewith and herein incorporated by reference.

In still further embodiments, an HPPD polypeptide, and a polynucleotide encoding the same, is provided, wherein the HPPD polypeptide comprises a heterologous chloroplast transit peptide that is not from the wild-type maize HPPD polypeptide or an active variant or fragment thereof. Such heterologous chloroplast transit peptides are known, including but not limited to those derived from *Pisum* (JP 1986224990; E00977), carrot (Luo et al. (1997) *Plant Mol. Biol.,* 33 (4), 709-722 (Z33383), *Nicotiana* (Bowler et al., EP 0359617; A09029), *Oryza* (de Pater et al. (1990) *Plant Mol. Biol.,* 15 (3), 399-406 (X51911), as well as synthetic sequences such as those provided in EP 0189707; U.S. Pat. No. 5,728,925; U.S. Pat. No. 5,717,084 (A10396 and A10398). In one embodiment, the heterologous chloroplast transit peptide is from the ribulose-1,5-bisphosphate carboxylase (Rubisco) small subunit precursor protein isolated from any plant. The Rubisco small subunit is well characterized from a variety of plants and the transit peptide from any of them will be suitable for use in the present invention. See for example, Physcomitrella (Quatrano et al., AW599738); Lotus (Poulsen et al., AW428760); *Citrullus* (J. S. Shin, AI563240); *Nicotiana* (Appleby et al. (1997) *Heredity* 79(6), 557-563); alfalfa (Khoudi et al. (1997) *Gene,* 197(1/2), 343-351); potato and tomato (Fritz et al. (1993) *Gene,* 137(2), 271-4); wheat (Galili et al. (1991) *Theor. Appl. Genet.* 81(1), 98-104); and rice (Xie et al. (1987) *Sci. Sin.,* Ser. B (Engl. Ed.), 30(7), 706-19). For example, transit peptides may be derived from the Rubisco small subunit isolated from plants including but not limited to, soybean, rapeseed, sunflower, cotton, corn, tobacco, alfalfa, wheat, barley, oats, sorghum, rice, *Arabidopsis*, sugar beet, sugar cane, canola, millet, beans, peas, rye, flax, and forage grasses. Preferred for use in the present invention is the Rubisco small subunit precursor protein from, for example, *Arabidopsis* or tobacco.

In other embodiments, the HPPD polypeptides and active variants and fragments thereof, and polynucleotide encoding the same, do not comprise a CTP. In such instances, the HPPD polypeptide and active variants and fragments thereof, or polynucleotides encoding the same, do not comprise a chloroplast transit peptide. Such polypeptides can be expressed in the cytoplasm of a plant, plant cell or explant and still confer insensitivity of the cell, plant or plant cell to an HPPD inhibitor. In still other embodiments, the HPPD polynucleotides lacking the chloroplast transit peptide are introduced directly into the chloroplast via chloroplast transformation. Such methods of chloroplast transformation are discussed in detail elsewhere herein.

Thus, further provided herein are HPPD polynucleotides and polypeptides and variants and fragments thereof that have HPPD activity and display insensitivity to an HPPD inhibitor and lack a chloroplast transit peptide. Such HPPD polypeptides include those set forth in any one of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 383, 384, 385, 386, 387, 388, 389, 404, 405, 406, 407, 408, 409, 410, 411, 412, 413, 414, 415, 416, 417, 418, 419, 420, 421, 422, 423, 424, 425, 426, 427, 428, 429, 430, 458, or 459 or active variants and fragments thereof, and the polynucleotide encoding the same, wherein said sequence lacks the chloroplast transit peptide. Various N-terminal truncations are described elsewhere herein.

In one embodiment, the HPPD polynucleotide and/or polypeptide comprises or encodes an N-terminal truncation of the HPPD polypeptide such that the CTP is removed or rendered inactive. Thus, in specific embodiments the HPPD polynucleotides encoding the HPPD polypeptide or the polypeptide comprise any one of SEQ ID NO:1-164 or 383-389, 404-430, or 458-459, wherein said sequence lacks or does not encode amino acids 1-10, as set forth in the corresponding SEQ ID NO; said sequence lacks or does not encode amino acids 1-15, as set forth in the corresponding SEQ ID NO; said sequence lacks or does not encode amino acids 1-20, as set forth in the corresponding SEQ ID NO; said sequence lacks or does not encode amino acids 1-23, as set forth in the corresponding SEQ ID NO; said sequence lacks or does not encode amino acids 1-25, as set forth in the corresponding SEQ ID NO; said sequence lacks or does not encode amino acids 1-30, as set forth in the corresponding SEQ ID NO; said sequence lacks or does not encode amino acids 1-35, as set forth in the corresponding SEQ ID NO; said sequence lacks or does not encode amino acids 1-40, as set forth in the corresponding SEQ ID NO; said sequence lacks or does not encode amino acids 1-45, as set forth in the corresponding SEQ ID NO; or said sequence lacks or does not encode amino acids 1-50, as set forth in the corresponding SEQ ID NO.

In other embodiments, the HPPD polypeptide or polynucleotide encoding the same, lacks the first 10, 11, 12, 13, 14, 15, 16, 17, 18, 19, 20, 21, 22, 23, 24, 25, 26, 27, 28, 29, 30, 31, 32, 33, 34, 35, 36, 0.37, 38, 39, 40, 41, 42, 43, 44, 45, 46, 47, 48, 49, or 50 or more amino acids of any one of SEQ ID NO: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 383, 384, 385, 386, 387, 388, 389, 404, 405, 406, 407, 408, 409, 410, 411, 412, 413, 414, 415, 416, 417, 418, 419, 420, 421, 422, 423, 424, 425, 426, 427, 428, 429, 430, 458, or 459 or biologically active variant or fragment thereof. In specific embodiments, the sequence set forth in any one of SEQ ID NO: 1-164, 383-389, 404-430, 458-459 or the polynucleotide encoding the same, lack the first the 2-23 amino acid of the corresponding SEQ ID NO. Further, any of the polypeptides disclosed herein having an HPPD motif as set forth in Table 18 (i.e., SEQ ID NOS: 372-382 or 460-463) or any one of the variants disclosed herein, such as those in Example 16, 18 and 20 can have the CTP removed, including at least the first 23 amino acids of the protein.

D. Sequence Comparisons

The following terms are used to describe the sequence relationships between two or more polynucleotides or polypeptides: (a) "reference sequence", (b) "comparison window", (c) "sequence identity", and, (d) "percent sequence identity."

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence or protein sequence.

(b) As used herein, "comparison window" makes reference to a contiguous and specified segment of a polypeptide sequence, wherein the polypeptide sequence in the comparison window may comprise additions or deletions (i.e., gaps) compared to the reference sequence (which does not comprise additions or deletions) for optimal alignment of the two polypeptides. Generally, the comparison window is at least 5, 10, 15, or 20 contiguous amino acid in length, or it can be 30, 40, 50, 100, or longer. Those of skill in the art understand that to avoid a high similarity to a reference sequence due to inclusion of gaps in the polypeptide sequence a gap penalty is typically introduced and is subtracted from the number of matches.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; the search-for-local-alignment method of Pearson and Lipman (1988) *Proc. Natl. Acad. Sci.* 85:2444-2448; the algorithm of Karlin and Altschul (1990) *Proc. Natl. Acad. Sci. USA* 872264, modified as in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) *Gene* 73:237-244 (1988); Higgins et al. (1989) *CABIOS* 5:151-153; Corpet et al. (1988) *Nucleic Acids Res.* 16:10881-90; Huang et al. (1992) *CABIOS* 8:155-65; and Pearson et al. (1994) *Meth. Mol. Biol.* 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The BLAST programs of Altschul et at (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. BLASTP protein searches can be performed using default parameters. See, blast.ncbi.nlm.nih.gov/Blast.cgi.

To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, or PSI-BLAST, the default parameters of the respective programs (e.g., BLASTN for nucleotide sequences, BLASTP for proteins) can be used. See www.ncbi.nlm.nih.gov. Alignment may also be performed manually by inspection.

In one embodiment, sequence identity/similarity values provided herein refer to the value obtained using GAP Version 10 using the following parameters: % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

GAP uses the algorithm of Needleman and Wunsch (1970) *J. Mol. Biol.* 48:443-453, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the GCG Wisconsin Genetics Software Package for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 200. Thus, for example, the gap creation and gap extension penalties can be 0, 1, 2, 3, 4, 5, 6, 7, 8, 9, 10, 15, 20, 25, 30, 35, 40, 45, 50, 55, 60, 65 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold. The scoring matrix used in Version 10 of the GCG Wisconsin Genetics Software Package is BLOSUM62 (see Henikoff and Henikoff (1989) *Proc. Natl. Acad. Sci. USA* 89:10915).

(c) As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity). When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percent sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

(d) As used herein, "percent sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percent sequence identity.

Figure 10F:
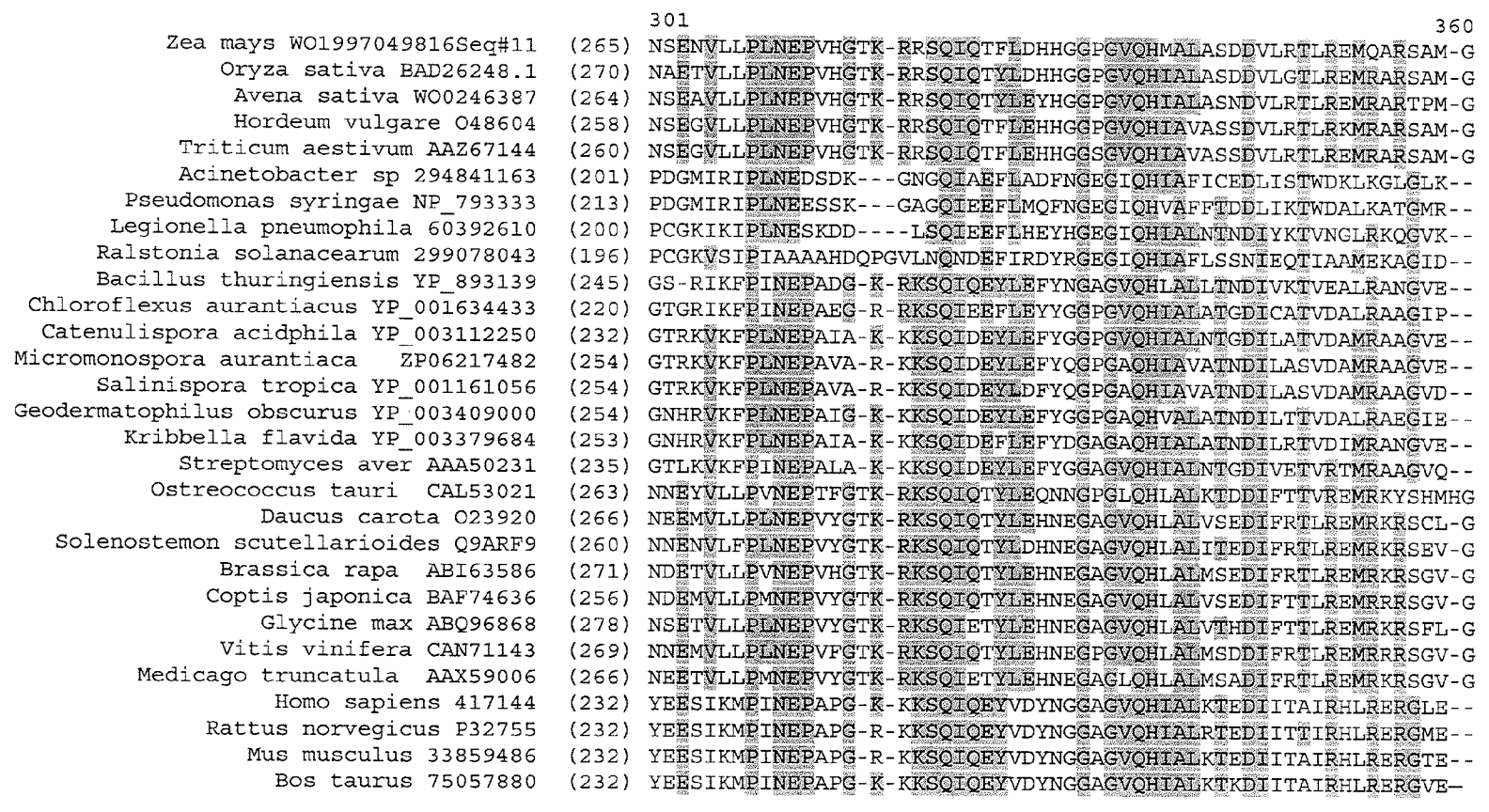
Figure 10H:
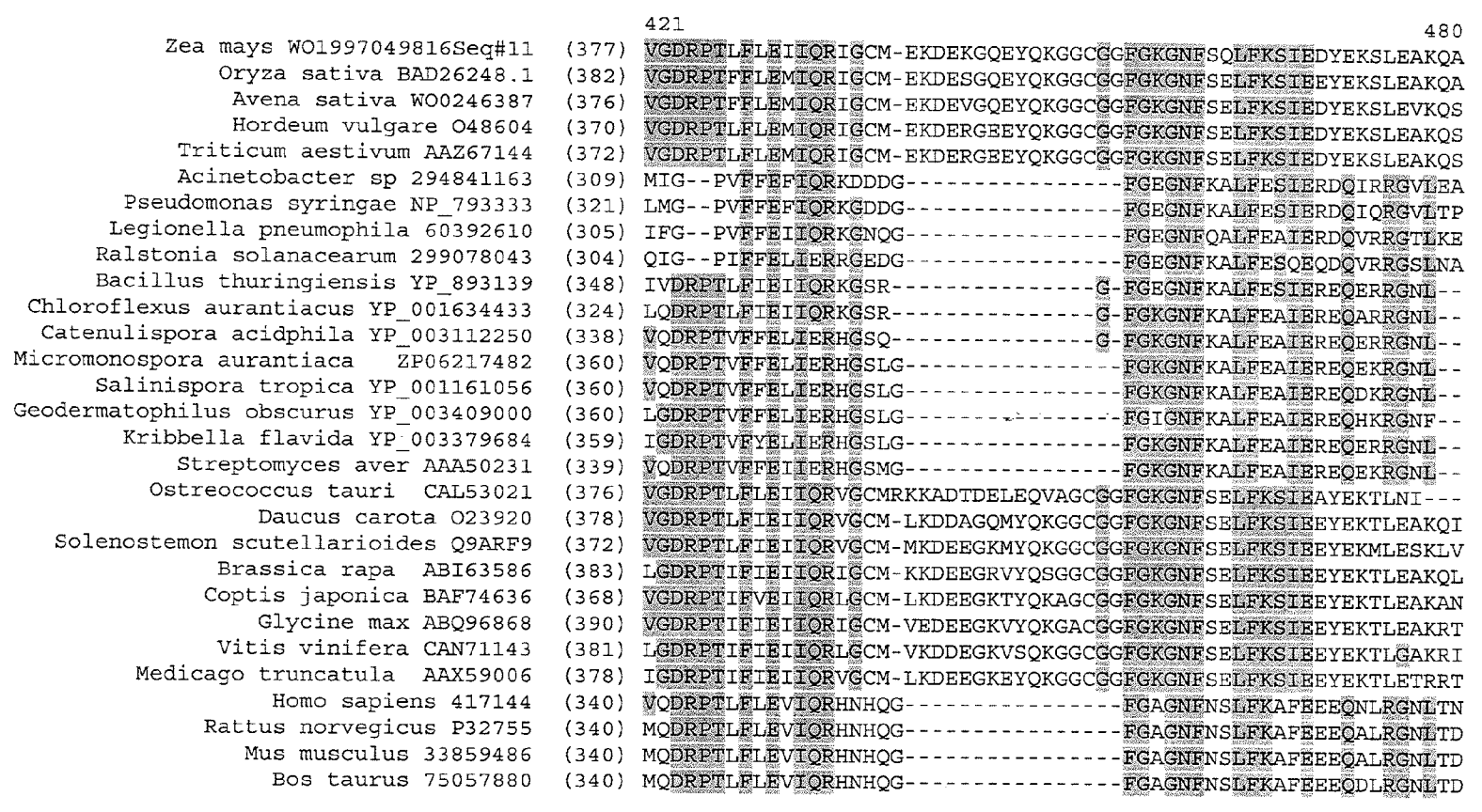

(e) Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acids substitution matrices and their use in quantifying the similarity between two sequences are well-known in the art and described, e.g., in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) Proc. Natl. Acad. Sci. USA 89:10915-10919. The BLOSUM62 matrix (FIG. 10) is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al, (1997) Nucleic Acids Res. 25:3389-3402, and made available to the public at the National Center for Biotechnology Information Website (ncbi.nlm.nih.gov). Optimal alignments, including multiple alignments, can be prepared using, e.g., PSI-BLAST, available through ncbi.nlm.nih.gov and described by Altschul et al, (1997) Nucleic Acids Res. 25:3389-3402.

As used herein, similarity score and bit score is determined employing the BLAST alignment used the BLOSUM62 substitution matrix, a gap existence penalty of 11, and a gap extension penalty of 1. For the same pair of sequences, if there is a numerical difference between the scores obtained when using one or the other sequence as query sequences, a greater value of similarity score is selected.

E. Plants

Plants, plant cells, plant parts and seeds, and grain having the HPPD sequences disclosed herein are provided. In specific embodiments, the plants and/or plant parts have stably incorporated at least one heterologous HPPD polypeptide disclosed herein or an active variant or fragment thereof. Thus, plants, plant cells, plant parts and seed are provided which comprise at least one heterologous HPPD sequences of any one of SEQ ID NOS: SEQ ID NO: 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 74, 65, 66, 67, 68, 69, 70, 71, 72, 73, 74, 75, 76, 77, 78, 79, 80, 81, 82, 83, 84, 85, 86, 87, 88, 89, 90, 61, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 212, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, or 168, 169, 170, 171, 172, 173, 174, 175, 176, 177, 178, 179, 180, 181, 182, 183, 184, 185, 186, 187, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 383, 384, 385, 386, 387, 388, 389, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 452, 453, 454, 455, 456, 457, 458, or 549 and any of the HPPD polypeptides disclosed herein having at least one of the HDDP motifs as set forth in Table 18 (i.e., SEQ ID NOS: 372-382 or 460-463) or any one of other variants disclosed herein, such as those in Example 16, 18 and 20 or a biologically active fragment and/or variant of the HPPD sequence. In specific embodiments, the HPPD sequences are characterized as having HPPD activity and having an insensitivity to an HPPD inhibitor.

Further provided are plants, plant cells, plant parts and seeds and grain having the HPPD sequences having a heterologous CTPs as discussed elsewhere herein. In light of employing HPPDs with and without CTP sequences, the term "stably incorporated" in a plant, plant cell or explant refers to the integration of the polynucleotide into the genomic DNA or to the integration of the polynucleotide into the genome of a plastid (i.e., the chloroplast, amyloplasts, chromoplasts, statoliths, leucoplasts, elaioplasts, and proteinoplasts).

In specific embodiments, the heterologous polynucleotide in the plant or plant part is operably linked to a constitutive, tissue-preferred, or other promoter for expression in plants.

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The HPPD sequences and active variant and fragments thereof disclosed herein may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (Citrus spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be employed in practicing the present invention include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*), and Poplar and *Eucalyptus*. In specific embodiments, plants of the present invention are crop plants (for example, corn, alfalfa, sunflower, *Brassica*, soybean, cotton, safflower, peanut, sorghum, wheat, millet, tobacco, etc.). In other embodiments, corn and soybean plants are optimal, and in yet other embodiments corn plants are optimal.

Other plants of interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

A "subject plant or plant cell" is one in which genetic alteration, such as transformation, has been affected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

F. Polynucleotide Constructs

The use of the term "polynucleotide" is not intended to limit the present invention to polynucleotides comprising DNA. Those of ordinary skill in the art will recognize that polynucleotides can comprise ribonucleotides and combinations of ribonucleotides and deoxyribonucleotides. Such deoxyribonucleotides and ribonucleotides include both naturally occurring molecules and synthetic analogues. The polynucleotides of the invention also encompass all forms of sequences including, but not limited to, single-stranded forms, double-stranded forms, hairpins, stem-and-loop structures, and the like.

The HPPD polynucleotides disclosed herein can be provided in expression cassettes for expression in the plant of interest. The cassette can include 5' and 3' regulatory sequences operably linked to an HPPD polynucleotide or active variant or fragment thereof. "Operably linked" is intended to mean a functional linkage between two or more elements. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions, by operably linked is intended that the coding regions are in the same reading frame. The cassette may additionally contain at least one additional gene to be cotransformed into the organism. Alternatively, the additional gene(s) can be provided on multiple expression cassettes. Such an expression cassette is provided with a plurality of restriction sites and/or recombination sites for insertion of the HPPD polynucleotide or active variant or fragment thereof to be under the transcriptional regulation of the regulatory regions. The expression cassette may additionally contain selectable marker genes.

The expression cassette can include in the 5'-3' direction of transcription, a transcriptional and translational initiation region (i.e., a promoter), an HPPD polynucleotide or active variant or fragment thereof, and a transcriptional and translational termination region (i.e., termination region) functional in plants. The regulatory regions (i.e., promoters, transcriptional regulatory regions, and translational termination regions) and/or the HPPD polynucleotide or active variant or fragment thereof may be native/analogous to the host cell or to each other. Alternatively, the regulatory regions and/or the HPPD polynucleotide of or active variant or fragment thereof may be heterologous to the host cell or to each other. As discussed in further detail elsewhere herein, the expression cassette can comprises a chimeric polynucleotide comprising a heterologous CTP operably linked to an HPPD polynucleotide.

As used herein, "heterologous" in reference to a sequence is a sequence that originates from a foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide.

While it may be optimal to express the sequences using heterologous promoters, the native promoter sequences may be used. Such constructs can change expression levels of the HPPD polynucleotide in the plant or plant cell. Thus, the phenotype of the plant or plant cell can be altered.

The termination region may be native with the transcriptional initiation region, may be native with the operably linked HPPD polynucleotide or active variant or fragment thereof, may be native with the plant host, or may be derived from another source (i.e., foreign or heterologous) to the promoter, the HPPD polynucleotide or active fragment or variant thereof, the plant host, or any combination thereof. Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Where appropriate, the polynucleotides may be optimized for increased expression in the transformed plant. That is, the polynucleotides can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein et al. (1989) *Proc. Natl. Acad. Sci. USA* 86:6126-6130); potyvirus leaders, for example, TEV leader (Tobacco Etch Virus) (Gallie et al. (1995) *Gene* 165(2):233-238), MDMV leader (Maize Dwarf Mosaic Virus) (*Virology* 154:9-20), and human immunoglobulin heavy-chain binding protein (BiP) (Macejak et al. (1991) *Nature* 353:90-94); untranslated leader from the coat protein mRNA of alfalfa mosaic virus (AMV RNA 4) (Jobling et al. (1987) *Nature* 325:622-625); tobacco mosaic virus leader (TMV) (Gallie et al. (1989) in *Molecular Biology of RNA*, ed. Cech (Liss, New York), pp. 237-256); and maize chlorotic mottle virus leader (MCMV) (Lommel et al. (1991) *Virology* 81:382-385. See also, Della-Cioppa et al. (1987) *Plant Physiol*. 84:965-968.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used to express the various HPPD sequence disclosed herein, including the native promoter of the polynucleotide sequence of interest. The promoters can be selected based on the desired outcome. Such promoters include, for example, constitutive, tissue-preferred, or other promoters for expression in plants.

Constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313: 810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced HPPD expression within a particular plant tissue. Tissue-preferred promoters include those described in Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6): 1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

As discussed in more detail elsewhere herein, promoters that direct expression in a plastid, such as a chloroplast, can also be used to express the HPPD sequences or biologically active variants and fragments thereof.

Synthetic promoters can be used to express HPPD sequences or biologically active variants and fragments thereof. In one non-limiting embodiment, the HPPD sequences are expressed with a synthetic constitutive promoter (for example U.S. Pat. Nos. 6,072,050 and 6,555,673) or with a promoter disclosed in U.S. Utility Application Ser. No. 13/209,017, now issued U.S. Patent No. 8,993,837, entitled "Chimeric Promoters and Methods of Use", filed concurrently herewith and herein incorporated by reference. In still further embodiments, the HPPD variants operably linked to such synthetic promoters further comprise an *Arabidopsis* ubiquitin3 gene terminator (Callis et al. (1995) *Genetics* 139 (2), 921-939; Genbank L05363).

Figure 7:
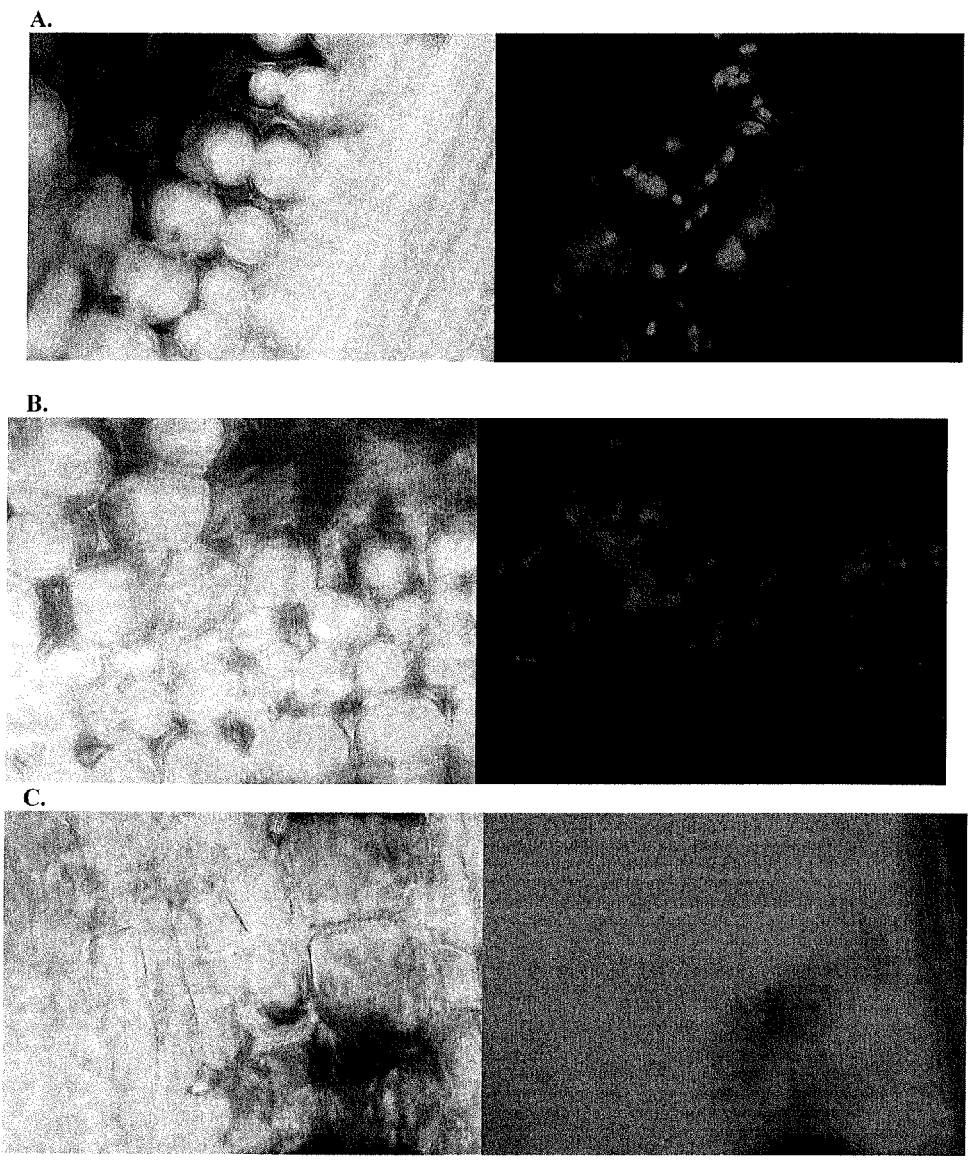
FIG. 7A-C provides fluorescence microscopy of maize leaf tissue transfected with chloroplast-targeted or untargeted DsRed.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glyphosate, glufosinate ammonium, bromoxynil, sulfonylureas, dicamba, and 2,4-dichlorophenoxyacetate (2,4-D). Additional selectable markers include phenotypic markers such as β-galactosidase and fluorescent proteins such as green fluorescent protein (GFP) (Su et al. (2004) *Biotechnol Bioeng* 85:610-9 and Fetter et al. (2004) *Plant Cell* 16:215-28), cyan florescent protein (CYP) (Bolte et al. (2004) *J. Cell Science* 117:943-54 and Kato et al. (2002) *Plant Physiol* 129:913-42), and yellow florescent protein (PhiYFP™ from Evrogen, see, Bolte et al. (2004) *J. Cell Science* 117:943-54). For additional selectable markers, see generally, Yarranton (1992) *Curr. Opin. Biotech.* 3:506-511; Christopherson et al. (1992) *Proc. Natl. Acad. Sci. USA* 89:6314-6318; Yao et al. (1992) *Cell* 71:63-72; Reznikoff (1992) *Mol. Microbiol.* 6:2419-2422; Barkley et al. (1980) in *The Operon*, pp. 177-220; Hu et al. (1987) *Cell* 48:555-566; Brown et al. (1987) *Cell* 49:603-612; Figge et al. (1988) *Cell* 52:713-722; Deuschle et al. (1989) *Proc. Natl. Acad. Aci. USA* 86:5400-5404; Fuerst et al. (1989) *Proc. Natl. Acad. Sci. USA* 86:2549-2553; Deuschle et al. (1990) *Science* 248:480-483; Gossen (1993) Ph.D. Thesis, University of Heidelberg; Reines et al. (1993) *Proc. Natl. Acad. Sci. USA* 90:1917-1921; Labow et al. (1990) *Mol. Cell. Biol.* 10:3343-3356; Zambretti et al. (1992) *Proc. Natl. Acad. Sci. USA* 89:3952-3956; Baim et al. (1991) *Proc. Natl. Acad. Sci. USA* 88:5072-5076; Wyborski et al. (1991) *Nucleic Acids Res.* 19:4647-4653; Hillenand-Wissman (1989) *Topics Mol. Struc. Biol.* 10:143-162; Degenkolb et al. (1991) *Antimicrob. Agents Chemother.* 35:1591-1595; Kleinschnidt et al. (1988) *Biochemistry* 27:1094-1104; Bonin (1993) Ph.D. Thesis, University of Heidelberg; Gossen et al. (1992) *Proc. Natl. Acad. Sci. USA* 89:5547-5551; Oliva et al. (1992) *Antimicrob. Agents Chemother.* 36:913-919; Hlavka et al. (1985) *Handbook of Experimental Pharmacology, Vol.* 78 (Springer-Verlag, Berlin); Gill et al. (1988) *Nature* 334:721-724. Such disclosures are herein incorporated by reference. The above list of selectable marker genes is not meant to be limiting. Any selectable marker gene can be used in the present invention, including for example, DsRed as described in Example 14 and FIG. 7.

G. Stacking Other Traits of Interest

In some embodiments, the HPPD polynucleotides or active variants and fragments thereof disclosed herein are engineered into a molecular stack. Thus, the various plants, plant cells and seeds disclosed herein can further comprise one or more traits of interest, and in more specific embodiments, the plant, plant part or plant cell is stacked with any combination of polynucleotide sequences of interest in order to create plants with a desired combination of traits. As used herein, the term "stacked" includes having the multiple traits present in the same plant (i.e., both traits are incorporated into the nuclear genome, one trait is incorporated into the nuclear genome and one trait is incorporated into the genome of a plastid, or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. In one embodiment, the molecular stack comprises at least one additional polynucleotide that also confers tolerance to at least one HPPD inhibitor and/or at least one additional polynucleotide that confers tolerance to a second herbicide.

Thus, in one embodiment, the plants, plant cells or plant part having the HPPD polynucleotide or active variants or fragments thereof disclosed herein is stacked with at least one other HPPD sequence. Such HPPD sequence include the HPPD sequence and variants and fragment thereof disclosed herein, as well as other HPPD sequence, which include but are not limited to the HPPD sequences set forth in U.S. Pat. Nos. 6,245,968 B1; 6,268,549; and 6,069,115; and international publication WO 99/23886, each of which is herein incorporated by reference.

In still other embodiments, plants, plant cells, explants and expression cassettes comprising the HPPD sequences or active variant and fragment thereof are stacked with a sequence that confers tolerance to HPPD inhibitors through a different mechanism than the HPPD polypeptide. For example, a P450 sequence could be employed which provides tolerance to HPPD-inhibitors by metabolism of the herbicide. Such sequences including, but are not limited to, the NSF1 gene. See, US 2007/0214515 and US 2008/0052797 both of which are herein incorporated by reference in their entirety.

In some embodiments, the plant or plant cells having the HPPD polynucleotides or active variants or fragment thereof may be stacked with other herbicide-tolerance traits to create a transgenic plant of the invention with further improved properties. Other herbicide-tolerance polynucleotides that could be used in such embodiments include those conferring tolerance to glyphosate such as, for example, glyphosate N-acetyltransferase. See, for example, WO02/36782, US Publication 2004/0082770 and WO 2005/012515, U.S. Pat. No. 7,462,481, U.S. Pat. No. 7,405,074, each of which is herein incorporated by reference.

Additional glyphosate-tolerance traits include a sequence that encodes a glyphosate oxido-reductase enzyme as described more fully in U.S. Pat. Nos. 5,776,760 and 5,463,175. Other traits that could be combined with the HPPD sequence disclosed herein include those derived from polynucleotides that confer on the plant the capacity to produce a higher level or glyphosate insensitive 5-enolpyruvylshikimate-3-phosphate synthase (EPSPS), for example, as more fully described in U.S. Pat. No. 6,248,876 B1; 5,627,061; 5,804,425; 5,633,435; 5,145,783; 4,971,908; 5,312,910; 5,188,642; 4,940,835; 5,866,775; 6,225,114 B1; 6,130,366; 5,310,667; 4,535,060; 4,769,061; 5,633,448; 5,510,471; Re. 36,449; RE 37,287 E; and 5,491,288; and international publications WO 97/04103; WO 00/66746; WO 01/66704; and WO 00/66747. Other traits that could be combined with the HPPD sequences disclosed herein include those conferring tolerance to sulfonylurea and/or imidazolinone, for example, as described more fully in U.S. Pat. Nos. 5,605,011; 5,013,659; 5,141,870; 5,767,361; 5,731,180; 5,304,732; 4,761,373; 5,331,107; 5,928,937; and 5,378,824; and international publication WO 96/33270.

Additional known genes that confer tolerance to herbicides and can be employed in the methods and compositions disclosed herein include, for example e.g., auxin, HPPD, glyphosate, dicamba, glufosinate, sulfonylurea, bromoxynil and norflurazon herbicides can be stacked either as a molecular stack or a breeding stack with plants expressing the traits disclosed herein. Polynucleotide molecules encoding proteins involved in herbicide tolerance include, but are not limited to, a polynucleotide molecule encoding 5-enolpyruvylshikimate-3-phosphate synthase (EPSPS) disclosed in U.S. Pat. Nos. US39,247; 6,566,587 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Pat. Nos. 7,622,641; 7,462,481; 7,531,339; 7,527,955; 7,709,709; 7,714,188 and 7,666,643 also for providing glyphosate tolerance; dicamba monooxygenase disclosed in U.S. Pat. No. 7,022,896 and WO2007146706A2 for providing dicamba tolerance; a polynucleotide molecule encoding AAD12 disclosed in U.S. Pat. App. Pub. No. 2005731044 or WO2007053482A2 or encoding AAD1 disclosed in US20110124503A1 or U.S. Pat. No. 7,838,733 for providing tolerance to auxin herbicides (2,4-D); a polynucleotide molecule encoding hydroxyphenylpyruvate dioxygenase (HPPD) for providing tolerance to HPPD inhibitors (e.g., hydroxyphenylpyruvate dioxygenase) disclosed in e.g., U.S. Pat. No. 7,935,869; US20090055976A1; and US20110023180A1; each publication is herein incorporated by reference in its entirety.

In other embodiments, the plants or plant cell or plant part having the HPPD sequence or an active variant or fragment thereof is stacked with, for example, a sequence which confers tolerance to an ALS inhibitor. As used herein, an "ALS inhibitor-tolerant polypeptide" comprises any polypeptide which when expressed in a plant confers tolerance to at least one ALS inhibitor. A variety of ALS inhibitors are known and include, for example, sulfonylurea, imidazolinone, triazolopyrimidines, pryimidinyoxy(thio)benzoates, and/or sulfonylaminocarbonyltriazolinone herbicides. Additional ALS inhibitors are known and are disclosed elsewhere herein. It is known in the art that ALS mutations fall into different classes with regard to tolerance to sulfonylureas, imidazolinones, triazolopyrimidines, and pyrimidinyl(thio)benzoates, including mutations having the following characteristics: (1) broad tolerance to all four of these groups; (2) tolerance to imidazolinones and pyrimidinyl(thio)benzoates; (3) tolerance to sulfonylureas and triazolopyrimidines; and (4) tolerance to sulfonylureas and imidazolinones.

Various ALS inhibitor-tolerant polypeptides can be employed. In some embodiments, the ALS inhibitor-tolerant polynucleotides contain at least one nucleotide mutation resulting in one amino acid change in the ALS polypeptide. In specific embodiments, the change occurs in one of seven substantially conserved regions of acetolactate synthase. See, for example, Hattori et al. (1995) *Molecular Genetics and Genomes* 246:419-425; Lee et al. (1998) *EMBO Journal* 7:1241-1248; Mazur et al. (1989) *Ann. Rev. Plant Phys.* 40:441-470; and U.S. Pat. No. 5,605,011, each of which is incorporated by reference in their entirety. The ALS inhibitor-tolerant polypeptide can be encoded by, for example, the SuRA or SuRB locus of ALS. In specific embodiments, the ALS inhibitor-tolerant polypeptide comprises the C3 ALS mutant, the HRA ALS mutant, the S4 mutant or the S4/HRA mutant or any combination thereof. Different mutations in ALS are known to confer tolerance to different herbicides and groups (and/or subgroups) of herbicides; see, e.g., Tranel and Wright (2002) *Weed Science* 50:700-712. See also, U.S. Pat. Nos. 5,605,011, 5,378,824, 5,141,870, and 5,013,659, each of which is herein incorporated by reference in their entirety. The soybean, maize, and *Arabidopsis* HRA sequences are disclosed, for example, in WO2007/024782, herein incorporated by reference.

In some embodiments, the ALS inhibitor-tolerant polypeptide confers tolerance to sulfonylurea and imidazolinone herbicides. The production of sulfonylurea-tolerant plants and imidazolinone-tolerant plants is described more fully in U.S. Pat. Nos. 5,605,011; 5,013,659; 5,141,870; 5,767,361; 5,731,180; 5,304,732; 4,761,373; 5,331,107; 5,928,937; and 5,378,824; and international publication WO 96/33270, which are incorporated herein by reference in their entireties for all purposes. In specific embodiments, the ALS inhibitor-tolerant polypeptide comprises a sulfonamide-tolerant acetolactate synthase (otherwise known as a sulfonamide-tolerant acetohydroxy acid synthase) or an imidazolinone-tolerant acetolactate synthase (otherwise known as an imidazolinone-tolerant acetohydroxy acid synthase).

In further embodiments, the plants or plant cell or plant part having the HPPD sequence or an active variant or fragment thereof is stacked with, or example, a sequence which confers tolerance to an ALS inhibitor and glyphosate tolerance. In one embodiment, the HPPD sequence or active variant or fragment thereof is stacked with HRA and a glyphosate N-acetyltransferase. See, WO2007/024782, 2008/0051288 and WO 2008/112019, each of which is herein incorporated by reference.

In still other embodiments, the plant or plant cell or plant part having the HPPD sequence or an active variant or fragment thereof may be stacked with, for example, aryloxyalkanoate dioxygenase polynucleotides (which confer tolerance to 2,4-D and other phenoxy auxin herbicides as well as to aryloxyphenoxypropionate herbicides as described, for example, in WO2005/107437) and dicamba-tolerance polynucleotides as described, for example, in Herman et al. (2005) *J. Biol. Chem.* 280: 24759-24767, auxin polypeptides and an acetyl coenzyme A carboxylase (ACCase) polypeptides.

Other examples of herbicide-tolerance traits that could be combined with the plant or plant cell or plant part having the HPPD sequence or an active variant or fragment thereof include those conferred by polynucleotides encoding an exogenous phosphinothricin acetyltransferase, as described in U.S. Pat. Nos. 5,969,213; 5,489,520; 5,550,318; 5,874,265; 5,919,675; 5,561,236; 5,648,477; 5,646,024; 6,177,616; and 5,879,903. Plants containing an exogenous phosphinothricin acetyltransferase can exhibit improved tolerance to glufosinate herbicides, which inhibit the enzyme glutamine synthase. Other examples of herbicide-tolerance traits that could be combined with the plants or plant cell or plant part having the HPPD sequence or an active variant or fragment thereof include those conferred by polynucleotides conferring altered protoporphyrinogen oxidase (protox) activity, as described in U.S. Pat. Nos. 6,288,306 B1; 6,282,837 B1; and 5,767,373; and international publication WO 01/12825. Plants containing such polynucleotides can exhibit improved tolerance to any of a variety of herbicides which target the protox enzyme (also referred to as "protox inhibitors").

Other examples of herbicide-tolerance traits that could be combined with the plants or plant cell or plant part having the HPPD sequence or an active variant or fragment thereof include those conferring tolerance to at least one herbicide in a plant such as, for example, a maize plant or horseweed. Herbicide-tolerant weeds are known in the art, as are plants that vary in their tolerance to particular herbicides. See, e.g., Green and Williams (2004) "Correlation of Corn (*Zea mays*) Inbred Response to Nicosulfuron and Mesotrione," poster presented at the WSSA Annual Meeting in Kansas City, Mo., Feb. 9-12, 2004; Green (1998) *Weed Technology* 12: 474-477; Green and Ulrich (1993) *Weed Science* 41: 508-516. The trait(s) responsible for these tolerances can be combined by breeding or via other methods with the plants or plant cell or plant part having the HPPD sequence or an active variant or fragment thereof to provide a plant of the invention as well as methods of use thereof.

In still further embodiments, the HPPD sequences can be stacked with at least one polynucleotide encoding a homogentisate solanesyltransferase (HST). See, for example, WO2010023911 herein incorporated by reference in its entirety. In such embodiments, classes of herbicidal compounds—which act wholly or in part by inhibiting HST can be applied over the plants having the HTS polypeptide.

The plant or plant cell or plant part having the HPPD sequence or an active variant or fragment thereof can also be combined with at least one other trait to produce plants that further comprise a variety of desired trait combinations including, but not limited to, traits desirable for animal feed such as high oil content (e.g., U.S. Pat. No. 6,232,529); balanced amino acid content (e.g., hordothionins (U.S. Pat. Nos. 5,990,389; 5,885,801; 5,885,802; and 5,703,409; U.S. Pat. No. 5,850,016); barley high lysine (Williamson et al. (1987) *Eur. J. Biochem.* 165: 99-106; and WO 98/20122) and high methionine proteins (Pedersen et al. (1986) *J. Biol. Chem.* 261: 6279; Kirihara et al. (1988) *Gene* 71: 359; and Musumura et al. (1989) *Plant Mol. Biol.* 12:123)); increased digestibility (e.g., modified storage proteins (U.S. application Ser. No. 10/053,410, filed Nov. 7, 2001); and thioredoxins (U.S. application Ser. No. 10/005,429, filed Dec. 3, 2001)); the disclosures of which are herein incorporated by reference. Desired trait combinations also include LLNC (low linolenic acid content; see, e.g., Dyer et al. (2002) *Appl. Microbiol. Biotechnol.* 59: 224-230) and OLCH (high oleic acid content; see, e.g., Fernandez-Moya et al. (2005) *J. Agric. Food Chem.* 53: 5326-5330).

The plant or plant cell or plant part having the HPPD sequence or an active variant or fragment thereof can also be combined with other desirable traits such as, for example, fumonisim detoxification genes (U.S. Pat. No. 5,792,931), avirulence and disease resistance genes (Jones et al. (1994) *Science* 266: 789; Martin et al. (1993) *Science* 262: 1432; Mindrinos et al. (1994) *Cell* 78: 1089), and traits desirable for processing or process products such as modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170:5837-5847) facilitate expression of polyhydroxyalkanoates (PHAs)); the disclosures of which are herein incorporated by reference. One could also combine herbicide-tolerant polynucleotides with polynucleotides providing agronomic traits such as male sterility (e.g., see U.S. Pat. No. 5,583,210), stalk strength, flowering time, or transformation technology traits such as cell cycle regulation or gene targeting (e.g., WO 99/61619, WO 00/17364, and WO 99/25821); the disclosures of which are herein incorporated by reference.

In other embodiments, the plant or plant cell or plant part having the HPPD sequence or an active variant or fragment thereof may be stacked with any other polynucleotides encoding polypeptides having pesticidal and/or insecticidal activity, such as *Bacillus thuringiensis* toxic proteins (described in U.S. Pat. Nos. 5,366,892; 5,747,450; 5,737,514; 5,723,756; 5,593,881; Geiser et al. (1986) *Gene* 48: 109; Lee et al. (2003) *Appl. Environ. Microbiol.* 69: 4648-4657 (Vip3A); Galitzky et al. (2001) *Acta Crystallogr. D. Biol. Crystallogr.* 57: 1101-1109 (Cry3Bb1); and Herman et al. (2004) *J. Agric. Food Chem.* 52: 2726-2734 (Cry1F)), lectins (Van Damme et al. (1994) *Plant Mol. Biol.* 24: 825, pentin (described in U.S. Pat. No. 5,981,722), and the like. The combinations generated can also include multiple copies of any one of the polynucleotides of interest.

In another embodiment, the plant or plant cell or plant part having the HPPD sequence or an active variant or fragment thereof can also be combined with the Rcg1 sequence or biologically active variant or fragment thereof. The Rcg1 sequence is an anthracnose stalk rot resistance gene in corn. See, for example, U.S. patent application Ser. Nos. 11/397, 153, 11/397,275, and 11/397,247, each of which is herein incorporated by reference.

These stacked combinations can be created by any method including, but not limited to, breeding plants by any conventional methodology, or genetic transformation. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853, all of which are herein incorporated by reference.

H. Method of Introducing

Various methods can be used to introduce a sequence of interest into a plant or plant part. "Introducing" is intended to mean presenting to the plant, plant cell or plant part the polynucleotide or polypeptide in such a manner that the sequence gains access to the interior of a cell of the plant. The methods of the invention do not depend on a particular method for introducing a sequence into a plant or plant part, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is intended to mean that the nucleotide construct introduced into a plant integrates into the genome of the plant and is capable of being inherited by the progeny thereof "Transient transformation" is intended to mean that a polynucleotide is introduced into the plant and does not integrate into the genome of the plant or a polypeptide is introduced into a plant.

Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. No. 5,563,055 and U.S. Pat. No. 5,981,840), direct gene transfer (Paszkowski et al. (1984) *EMBO J.* 3:2717-2722), and ballistic particle acceleration (see, for example, U.S. Pat. No. 4,945,050; U.S. Pat. No. 5,879,918; U.S. Pat. Nos. 5,886,244; and, 5,932,782; Tomes et al. (1995) in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature (London)* 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, New York), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

In specific embodiments, the HPPD sequences or active variant or fragments thereof can be provided to a plant using a variety of transient transformation methods. Such transient transformation methods include, but are not limited to, the introduction of the HPPD protein or active variants and fragments thereof directly into the plant. Such methods include, for example, microinjection or particle bombardment. See, for example, Crossway et al. (1986) *Mol Gen. Genet.* 202: 179-185; Nomura et al. (1986) *Plant Sci.* 44:53-58; Hepler et al. (1994) *Proc. Natl. Acad. Sci.* 91: 2176-2180 and Hush et al. (1994) *The Journal of Cell Science* 107:775-784, all of which are herein incorporated by reference.

In other embodiments, the polynucleotide of the invention may be introduced into plants by contacting plants with a virus or viral nucleic acids. Generally, such methods involve incorporating a nucleotide construct of the invention within a DNA or RNA molecule. It is recognized that the an HPPD sequence may be initially synthesized as part of a viral polyprotein, which later may be processed by proteolysis in vivo or in vitro to produce the desired recombinant protein. Further, it is recognized that promoters of the invention also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221; herein incorporated by reference.

Methods are known in the art for the targeted insertion of a polynucleotide at a specific location in the plant genome. In one embodiment, the insertion of the polynucleotide at a desired genomic location is achieved using a site-specific recombination system. See, for example, WO99/25821, WO99/25854, WO99/25840, WO99/25855, and WO99/25853, all of which are herein incorporated by reference. Briefly, the polynucleotide of the invention can be contained in transfer cassette flanked by two non-recombinogenic recombination sites. The transfer cassette is introduced into a plant having stably incorporated into its genome a target site which is flanked by two non-recombinogenic recombination sites that correspond to the sites of the transfer cassette. An appropriate recombinase is provided and the transfer cassette is integrated at the target site. The polynucleotide of interest is thereby integrated at a specific chromosomal position in the plant genome. Other methods to target polynucleotides are set forth in WO 2009/114321 (herein incorporated by reference), which describes "custom" meganucleases produced to modify plant genomes, in particular the genome of maize. See, also, Gao et al. (2010) *Plant Journal* 1:176-187.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting progeny having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a polynucleotide of the invention, for example, an expression cassette of the invention, stably incorporated into their genome.

I. Chloroplast Transformation

In specific embodiments, the HPPD polypeptides and active variants and fragments thereof, and polynucleotide encoding the same, do not comprise or encode a CTP. Such polynucleotides can be expressed from the nuclear genome of a plant, plant cell, or explants and the polypeptides acting from the cytoplasm still confer insensitivity of the cell, plant or plant cell to an HPPD inhibitor. In still other embodiments, the HPPD polynucleotides lacking the chloroplast transit peptide are introduced directly into the chloroplast via chloroplast transformation. Such methods of chloroplast transformation are discussed in detail elsewhere herein. Thus, chloroplasts having stably incorporated in their genome a polynucleotide encoding an HPPD polypeptide or an active variant or fragment thereof lacking a CTP as described herein are provided.

In other embodiments, only the HPPD polypeptides or active variants and fragments thereof are in the chloroplast of a plant or plant cell. In such instances, the HPPD polypeptide can comprise a chloroplast transit peptide and can be expressed from a polynucleotide incorporated into the nuclear genome. In such an instance, the HPPD polypeptide is transported into the chloroplast, the CTP is removed, and the mature form of the HPPD polypeptide is then found within the chloroplast.

In other embodiments, the polynucleotide encoding the HPPD polypeptide or active variant or fragment thereof is incorporated directly into the genome of the chloroplast. In such instances, the HPPD polypeptide need not comprise a CTP.

The sequences to be targeted to the chloroplast may be optimized for expression in the chloroplast to account for differences in codon usage between the plant nucleus and this organelle. In this manner, the polynucleotide of interest may be synthesized using chloroplast-preferred codons. See, for example, U.S. Pat. No. 5,380,831, herein incorporated by reference.

As used herein, a "plastid" refers to an organelle present in plant cells that stores and manufactures chemical compounds used by the cell, such as starch, fatty acids, terpenes, and that has been derived from a proplastid. Thus, plastids of plants typically have the same genetic content. Plastids include chloroplasts, which are responsible for photosynthesis, amyloplasts, chromoplasts, statoliths, leucoplasts, elaioplasts, and proteinoplasts.

The plastid genome is circular and varies in size among plant species from about 120 to about 217 kilobase pairs (kb). The genome typically includes a large inverted repeat, which can contain up to about 76 kilobase pairs, but which is more typically in the range of about 20 to about 30 kilobase pairs. The inverted repeat present in the plastid genome of various organisms has been described (Palmer (1990) *Trends Genet* 6:115-120).

Methods are known in the art for introducing genes into the plastid genome. See, for example, Svab et al. (1990) *Proc. Natl. Acad. Sci. USA* 87: 8526-8530; Svab and Maliga (1993) *Proc. Natl. Acad. Sci. USA* 90: 913-917; Svab and Maliga (1993) *EMBO J.* 12: 601-606; and U.S. Pat. Nos. 5,451,513 and 5,545,818; each of which is herein incorporated by reference in its entirety.

One method involves the integration of a polynucleotide of interest into the plastid genome through homologous recombination. Such methods involve the introduction of a polynucleotide of interest flanked by regions of homology with regions of the plastid genome into a plant cell. Delivery of the polynucleotide of interest into the plant cell can be via any method of transformation known in the art, including those described elsewhere herein. These include, but are not limited to, particle gun delivery (Svab, Z. et al. (1990) *Proc Natl Acad Sci USA* 87:8526-8530; Svab and Maliga (1993) *Proc Natl Acad Sci USA* 90:913-917; and Staub and Maliga (1993) *EMBO J* 12:601-606; and U.S. Pat. Nos. 5,451,513 and 5,545,818; each of which is herein incorporated by reference in its entirety). In some species, protoplasts can also be used for chloroplast transformation (O'Neill et al. (1993) *Plant J* 3:729-38; and Spoerlein et al. (1991) *Theor* Appl Gen 82:717-722; each of which is herein incorporated by reference in its entirety). Once the polynucleotide of interest flanked by the homologous regions enters the cell, the polynucleotide of interest will be integrated within the plastid genome.

The homologous regions flanking the polynucleotide of interest, and in some embodiments, its operably linked promoter, and in particular embodiments, the selectable marker gene as well may vary in length. In some embodiments, the region of homology with the plastid genome is about 50, 75, 100, 200, 300, 400, 500, 600, 700, 800, 900, 1000 base pairs or greater in length. In most instances, the frequency of recombination and thus the frequency of obtaining plants having transformed plastids decreases with the decreasing size of the homologous regions. In those embodiments wherein the regions of homology are present in the inverted repeat regions of the plastid genome, two copies of the polynucleotide of interest are expected per transformed plastid.

In some embodiments, the polynucleotide of interest can be co-delivered with a selectable marker gene that is active in the plastid. The selectable marker gene and the polynucleotide of interest can be present on a single DNA construct or on separate constructs. A number of markers have been developed for use with plant cells, such as resistance to chloramphenicol, the aminoglycoside G418, hygromycin, or the like. Genes conferring resistance to kanamycin (NPTII or AphA6) have been used as a selectable marker for plastid transformation (Carrer et al. (1993) *Mol Gen Genetics* 241:49-56; and Huang et al. (2002) *Mol Gen Genomics* 268:19-27; each of which is herein incorporated by reference in its entirety).

Other genes which encode a product involved in chloroplast metabolism may also be used as selectable markers.

Another example of a selectable marker gene for plastid transformation is a selectable marker gene that confers resistance to a substance which inhibits protein synthesis by the plastids, such that cells which have acquired the phenotype are selected for by contacting the cells with a substance which inhibits protein synthesis by the plastids. The plastid DNA encoding the nonlethal selectable phenotype may comprise 16S ribosomal DNA mutated to confer resistance to the effects of streptomycin, or to spectinomycin, or to both antibiotics simultaneously. Expression of heterologous genes that modify non-lethal antibiotics such as streptomycin or spectinomycin by phosphorylation, adenylation or acetylation also are suitable for the selection of plastid transformation events. Another non-limiting example of a gene that confers resistance to streptomycin and spectinomycin is the bacterial aadA gene that codes for streptomycin/spectinomycin adenyltransferase (Svab et al. (1993) *Proc Natl Acad Sci USA* 90:913-917). The aadA gene product allows for continued growth and greening of cells in the presence of streptomycin or spectinomycin whose chloroplasts comprise the selectable marker gene product. Cells which do not contain the selectable marker gene product are bleached. Selection for the aadA gene marker is thus based on identification of plant cells which are not bleached by the presence of streptomycin or spectinomycin, in the plant growth medium.

Other examples of selectable marker genes are those that confer resistance to an herbicide, including a photosystem II herbicide, such as a triazine herbicide, specifically the triazine herbicide atrazine. This phenotype not only provides nonlethal selection, but also provides herbicide resistance. Genes that provide resistance to plant herbicides such as glyphosate, bromoxynil, or imidazolinone may find use as a selectable marker gene. Such genes have been reported (Stalker et al. (1985) *J Biol Chem* 260:4724-4728 (glyphosate resistant EPSP); Stalker et al. (1985) *J Biol Chem* 263:6310-6314 (bromoxynil resistant nitrilase gene); and Sathasivan et al. (1990) *Nucl Acids Res* 18:2188 (AHAS imidazolinone resistance gene); each of which is herein incorporated by reference in its entirety).

The selectable marker gene and/or the polynucleotide of interest can be placed under the regulatory control of a chloroplast 5' promoter and 3' transcription termination regions, such as the tobacco 16S rRNA promoter rrn region and rps16 3' termination region. Numerous additional promoter regions may also be used to drive expression of the selectable marker gene and/or the polynucleotide of interest, including various plastid promoters and bacterial promoters which have been shown to function in plant plastids. Further, if nuclear expression of the selectable marker gene and/or the polynucleotide of interest is not desired, plastid introns can be incorporated into the selectable marker gene and/or the polynucleotide of interest. Certain classes of plastid introns cannot be correctly spliced out in the nucleus, thereby preventing expression of the selectable marker gene and/or the polynucleotide of interest within the nucleus. The polynucleotide of interest and/or the heterologous polynucleotide encoding the cell proliferation factor may be optimized for expression in the chloroplast to account for differences in codon usage between the plant nucleus and this organelle. In this manner, the polynucleotide may be synthesized using chloroplast-preferred codons. See, for example, U.S. Pat. No. 5,380,831, herein incorporated by reference.

An additional method of plastid transformation occurs through the transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91: 7301-7305, which is herein incorporated by reference in its entirety. In these methods, the heterologous polynucleotide encoding the cell proliferation factor is introduced into the cell and expressed prior to, during, or immediately after the expression of the plastid-directed RNA polymerase.

In order to select those cells having transformed plastids, following introduction of the chloroplast transformation vectors, the treated tissue is placed on tissue culture medium containing the appropriate selection agent. After a suitable period of incubation on selection medium, transformed cells can be identified and grown to a stage that allows regeneration of the whole plants. The regeneration processes are basically identical to those used for standard nuclear transformation events. Special care must be taken to ensure that selection and regeneration conditions promote the elimination of most wild-type chloroplast genomes. The status of the proportion of wild-type to transformed chloroplast genomes can be monitored by standard molecular techniques including Southern and PCR analysis.

For tobacco and a number of other species, leaves are a preferred target for plastid transformation. Chloroplast transformation has been described for tobacco (Svab, Zora; Hajdukiewicz et al. (1990) *Proceedings of the National Academy of Sciences of the United States of America* 87(21):8526-30), *Arabidopsis* (Sikdar, S. R.; Serino, G.; Chaudhuri, S.; Maliga, P (1998) *Plant Cell Reports* 18(1-2):20-24), tomato (Ruf et al. (2001) *Nature Biotechnology:* 19(9):870-875), potato (Sidorov et al. (1999) *Plant Journal* 19(2): 209-216). For soybean, embryogenic suspension cultures can be targeted for transformation (Dufourmantel et al. (2004) *Plant Molecular Biology:*55(4), 479-489; US20070039075 A1).

II. Methods of Use

A. Methods for Increasing Expression and/or Concentration of at Least One HPPD Sequence or an Active Variant or Fragment Therefore in a Plant or Plant Part A method for increasing the activity and/or concentration of an HPPD polypeptide disclosed herein or an active variant or fragment thereof in a plant, plant cell, plant part, explant, seed, or a chloroplast is provided. HPPD activity and insensitivity to HPPD inhibitors are discussed in detail elsewhere herein. In further embodiments, the concentration/level of the HPPD polypeptide is increased in a plant or plant part by at least 10%, 20%, 30%, 40%, 50%, 60%, 70%, 80%, 90%, 100%, 200%, 500%, 1000%, 5000%, or 10,000% relative to an appropriate control plant, plant part, or cell which did not have the HPPD sequence. In still other embodiments, the level of the HPPD polypeptide in the plant or plant part is increased by 10, 20, 30, 40, 50, 60, 70, 80, 90, 100 fold or more compared to the level of the native HPPD sequence. Such an increase in the level of the HPPD polypeptide can be achieved in a variety of ways including, for example, by the expression of multiple copies of one or more HPPD polypeptide and/or by employing a promoter to drive higher levels of expression of the sequence.

In specific embodiments, the polypeptide or the HPPD polynucleotide or active variant or fragment thereof is introduced into the plant, plant cell, explant or plant part. Subsequently, a plant cell having the introduced sequence of the invention is selected using methods known to those of skill in the art such as, but not limited to, Southern blot analysis, DNA sequencing, PCR analysis, or phenotypic analysis. A plant or plant part altered or modified by the foregoing embodiments is grown under plant forming conditions for a time sufficient to modulate the concentration and/or activity of polypeptides of the present invention in the plant. Plant forming conditions are well known in the art and discussed briefly elsewhere herein.

In one embodiment, a method of producing an HPPD herbicide tolerant plant cell is provided and comprises transforming a plant cell with the polynucleotide encoding an HPPD polypeptide or active variant or fragment thereof. In specific embodiments, the method further comprises selecting a plant cell which is resistant or tolerant to an HPPD herbicide by growing the plant cells in a sufficient concentration of an HPPD herbicide, such that the herbicide bleaches the plant cells which do not comprise the HPPD polypeptide of interest.

It is recognized that the incubation of the cells with the HPPD herbicide can occur before or after transformation with the HPPD polynucleotide of interest. For example, in one embodiment, method comprises culturing a plant cell in the presence of a sufficient concentration of an HPPD herbicide such that said plant cells display bleaching and then transforming into the bleached plant cells a polynucleotide encoding an HPPD polypeptide as disclosed herein. The plant cells are then grown, wherein the transformed plants cells no longer display bleaching. See, for example, U.S. Pat. No. 6,791,014, herein incorporated by reference it its entirety.

It is also recognized that the level and/or activity of the native HPPD sequence in a plant may be altered by employing a polynucleotide that is not capable of directing, in a transformed plant, the expression of a protein or an RNA. For example, the HPPD polynucleotide or active variant or fragment thereof disclosed herein may be used to design polynucleotide constructs that can be employed in methods for altering or mutating a genomic nucleotide sequence in an organism. Such polynucleotide constructs include, but are not limited to, RNA:DNA vectors, RNA:DNA mutational vectors, RNA:DNA repair vectors, mixed-duplex oligonucleotides, self-complementary RNA:DNA oligonucleotides, and recombinogenic oligonucleobases. Such nucleotide constructs and methods of use are known in the art. See, U.S. Pat. Nos. 5,565,350; 5,731,181; 5,756,325; 5,760,012; 5,795,972; and 5,871,984; all of which are herein incorporated by reference. See also, WO 98/49350, WO 99/07865, WO 99/25821, and Beetham et al. (1999) *Proc. Natl. Acad. Sci. USA* 96:8774-8778; herein incorporated by reference.

It is therefore recognized that methods of the present invention do not depend on the incorporation of the entire polynucleotide into the genome, only that the plant or cell thereof is altered as a result of the introduction of the polynucleotide into a cell. In one embodiment of the invention, the genome may be altered following the introduction of the polynucleotide into a cell. Alterations to the genome of the present invention include, but are not limited to, additions, deletions, and substitutions of nucleotides into the genome. While the methods of the present invention do not depend on additions, deletions, and substitutions of any particular number of nucleotides, it is recognized that such additions, deletions, or substitutions comprises at least one nucleotide.

B. Method of Producing Crops and Controlling Weeds

Methods for controlling weeds in an area of cultivation, preventing the development or the appearance of herbicide resistant weeds in an area of cultivation, producing a crop, and increasing crop safety are provided. The term "controlling," and derivations thereof, for example, as in "controlling weeds" refers to one or more of inhibiting the growth, germination, reproduction, and/or proliferation of; and/or killing, removing, destroying, or otherwise diminishing the occurrence and/or activity of a weed.

As used herein, an "area of cultivation" comprises any region in which one desires to grow a plant. Such areas of cultivations include, but are not limited to, a field in which a plant is cultivated (such as a crop field, a sod field, a tree field, a managed forest, a field for culturing fruits and vegetables, etc), a greenhouse, a growth chamber, etc.

As used herein, by "selectively controlled" it is intended that the majority of weeds in an area of cultivation are significantly damaged or killed, while if crop plants are also present in the field, the majority of the crop plants are not significantly damaged. Thus, a method is considered to selectively control weeds when at least 55%, 60%, 65%, 70%, 75%, 80%, 85%, 90%, 95%, or more of the weeds are significantly damaged or killed, while if crop plants are also present in the field, less than 45%, 40%, 35%, 30%, 25%, 20%, 15%, 10%, 5%, or 1% of the crop plants are significantly damaged or killed.

Methods provided comprise planting the area of cultivation with a plant having an HPPD sequence or active variant or fragment thereof disclosed herein or transgenic seed derived there from, and in specific embodiments, applying to the crop, seed, weed or area of cultivation thereof an effective amount of a herbicide of interest. It is recognized that the herbicide can be applied before or after the crop is planted in the area of cultivation. Such herbicide applications can include an application of an HPPD inhibitor including, but not limited to, triketones (such as, mesotrione, sulcotrione, topremezone, and tembotrione) including agriculturally suitable salts (e.g., sodium salts) thereof; isoxazoles (such as, pyrasulfotole and isoxaflutole) including agriculturally suitable salts (e.g., sodium salts) thereof; pyrazoles (such as, benzofenap, pyrazoxyfen, and pyrazolynate) including agriculturally suitable salts (e.g., sodium salts) thereof; and benzobicyclon, including agriculturally suitable salts (e.g., sodium salts) thereof. See, WO2005/053407. In specific embodiments, a combination of two or more HPPD inhibitors is applied. Generally, the effective amount of herbicide applied to the field is sufficient to selectively control the weeds without significantly affecting the crop.

"Weed" as used herein refers to a plant which is not desirable in a particular area. Conversely, a "crop plant" as used herein refers to a plant which is desired in a particular area, such as, for example, a maize or soy plant. Thus, in some embodiments, a weed is a non-crop plant or a non-crop species, while in some embodiments, a weed is a crop species which is sought to be eliminated from a particular area, such as, for example, an inferior and/or non-transgenic soy plant in a field planted with a plant having the HPPD sequence disclosed herein or an active variant or fragment thereof.

Further provided is a method for producing a crop by growing a crop plant that is tolerant to an HPPD herbicide as a result of being transformed with an HPPD polynucleotide or active variant or fragment thereof disclosed herein, under conditions such that the crop plant produces a crop, and harvesting the crop. Preferably, an HPPD inhibitor is applied to the plant, or in the vicinity of the plant, at a concentration effective to control weeds without preventing the transgenic crop plant from growing and producing the crop. The application of the HPPD inhibitor can be before planting, or at any time after planting up to and including the time of harvest. The HPPD inhibitor can be applied once or multiple times. The timing of the HPPD inhibitor application, amount applied, mode of application, and other parameters will vary based upon the specific nature of the crop plant and the growing environment, and can be readily determined by one of skill in the art. The invention further provides the crop produced by this method.

Further provided are methods for the propagation of a plant containing a HPPD polypeptide or active variant or fragment thereof. The plant can be, for example, a monocot or a dicot. In one aspect, propagation entails crossing a plant containing a HPPD polynucleotide transgene with a second plant, such that at least some progeny of the cross display HPPD inhibitor tolerance.

The methods of the invention further allow for the development of herbicide applications to be used with the plants having the HPPD sequence or active variants or fragments thereof. In such methods, the environmental conditions in an area of cultivation are evaluated. Environmental conditions that can be evaluated include, but are not limited to, ground and surface water pollution concerns, intended use of the crop, crop tolerance, soil residuals, weeds present in area of cultivation, soil texture, pH of soil, amount of organic matter in soil, application equipment, and tillage practices. Upon the evaluation of the environmental conditions, an effective amount of a combination of herbicides can be applied to the crop, crop part, seed of the crop or area of cultivation.

Any herbicide or combination of herbicides can be applied to the plant having the HPPD sequence or active variant or fragment thereof disclosed herein or transgenic seed derived there from, crop part, or the area of cultivation containing the crop plant. By "treated with a combination of" or "applying a combination of herbicides to a crop, area of cultivation or field" it is intended that a particular field, crop or weed is treated with each of the herbicides and/or chemicals indicated to be part of the combination so that a desired effect is achieved, i.e., so that weeds are selectively controlled while the crop is not significantly damaged. The application of each herbicide and/or chemical may be simultaneous or the applications may be at different times (sequential), so long as the desired effect is achieved. Furthermore, the application can occur prior to the planting of the crop.

Classifications of herbicides (i.e., the grouping of herbicides into classes and subclasses) are well-known in the art and include classifications by HRAC (Herbicide Resistance Action Committee) and WSSA (the Weed Science Society of America) (see also, Retzinger and Mallory-Smith (1997) *Weed Technology* 11: 384-393). An abbreviated version of the HRAC classification (with notes regarding the corresponding WSSA group) is set forth below in Table 1.

Herbicides can be classified by their mode of action and/or site of action and can also be classified by the time at which they are applied (e.g., preemergent or postemergent), by the method of application (e.g., foliar application or soil application), or by how they are taken up by or affect the plant or by their structure. "Mode of action" generally refers to the metabolic or physiological process within the plant that the herbicide inhibits or otherwise impairs, whereas "site of action" generally refers to the physical location or biochemical site within the plant where the herbicide acts or directly interacts. Herbicides can be classified in various ways, including by mode of action and/or site of action (see, e.g., Table 1).

Often, a herbicide-tolerance gene that confers tolerance to a particular herbicide or other chemical on a plant expressing it will also confer tolerance to other herbicides or chemicals in the same class or subclass, such as, for example, a class or subclass set forth in Table 1. Thus, in some embodiments, a transgenic plant is tolerant to more than one herbicide or chemical in the same class or subclass, such as, for example, an HPPD inhibitor, glyphosate, an ALS chemistry, an inhibitor of PPO, a sulfonylurea, and/or a synthetic auxin.

Typically, the plants of the present invention can tolerate treatment with different types of herbicides (i.e., herbicides having different modes of action and/or different sites of action) thereby permitting improved weed management strategies that are recommended in order to reduce the incidence and prevalence of herbicide-tolerant weeds.

TABLE 1

Abbreviated version of HRAC Herbicide Classification

I. ALS Inhibitors (WSSA Group 2)
    A. Sulfonylureas
        1. Azimsulfuron
        2. Chlorimuron-ethyl
        3. Metsulfuron-methyl
        4. Nicosulfuron
        5. Rimsulfuron
        6. Sulfometuron-methyl
        7. Thifensulfuron-methyl
        8. Tribenuron-methyl
        9. Amidosulfuron
        10. Bensulfuron-methyl
        11. Chlorsulfuron
        12. Cinosulfuron
        13. Cyclosulfamuron
        14. Ethametsulfuron-methyl
        15. Ethoxysulfuron
        16. Flazasulfuron
        17. Flupyrsulfuron-methyl
        18. Foramsulfuron
        19. Imazosulfuron
        20. Iodosulfuron-methyl
        21. Mesosulfuron-methyl
        22. Oxasulfuron
        23. Primisulfuron-methyl
        24. Prosulfuron
        25. Pyrazosulfuron-ethyl
        26. Sulfosulfuron
        27. Triasulfuron
        28. Trifloxysulfuron
        29. Triflusulfuron-methyl
        30. Tritosulfuron
        31. Halosulfuron-methyl
        32. Flucetosulfuron
    B. Sulfonylaminocarbonyltriazolinones
        1. Flucarbazone
        2. Procarbazone
    C. Triazolopyrimidines
        1. Cloransulam-methyl
        2. Flumetsulam
        3. Diclosulam
        4. Florasulam
        5. Metosulam
        6. Penoxsulam
        7. Pyroxsulam
    D. Pyrimidinyloxy(thio)benzoates
        1. Bispyribac
        2. Pyriftalid
        3. Pyribenzoxim
        4. Pyrithiobac
        5. Pyriminobac-methyl
    E. Imidazolinones
        1. Imazapyr
        2. Imazethapyr
        3. Imazaquin
        4. Imazapic
        5. Imazamethabenz-methyl
        6. Imazamox
II. Other Herbicides--Active Ingredients/
    Additional Modes of Action
    A. Inhibitors of Acetyl CoA carboxylase
        (ACCase) (WSSA Group 1)
        1. Aryloxyphenoxypropionates ('FOPs')
            a. Quizalofop-P-ethyl
            b. Diclofop-methyl
            c. Clodinafop-propargyl
            d. Fenoxaprop-P-ethyl

TABLE 1-continued

Abbreviated version of HRAC Herbicide Classification e. Fluazifop-P-butyl
   f. Propaquizafop
   g. Haloxyfop-P-methyl
   h. Cyhalofop-butyl
   i. Quizalofop-P-ethyl
  2. Cyclohexanediones ('DIMs')
   a. Alloxydim
   b. Butroxydim
   c. Clethodim
   d. Cycloxydim
   e. Sethoxydim
   f. Tepraloxydim
   g. Tralkoxydim
 B. Inhibitors of Photosystem II-HRAC
 Group C1/WSSA Group 5
  1. Triazines
   a. Ametryne
   b. Atrazine
   c. Cyanazine
   d. Desmetryne
   e. Dimethametryne
   f. Prometon
   g. Prometryne
   h. Propazine
   i. Simazine
   j. Simetryne
   k. Terbumeton
   l. Terbuthylazine
   m. Terbutryne
   n. Trietazine
  2. Triazinones
   a. Hexazinone
   b. Metribuzin
   c. Metamitron
  3. Triazolinone
   a. Amicarbazone
  4. Uracils
   a. Bromacil
   b. Lenacil
   c. Terbacil
  5. Pyridazinones
   a. Pyrazon
  6. Phenyl carbamates
   a. Desmedipham
   b. Phenmedipham
 C. Inhibitors of Photosystem II--HRAC
 Group C2/WSSA Group 7
  1. Ureas
   a. Fluometuron
   b. Linuron
   c. Chlorobromuron
   d. Chlorotoluron
   e. Chloroxuron
   f. Dimefuron
   g. Diuron
   h. Ethidimuron
   i. Fenuron
   j. Isoproturon
   k. Isouron
   l. Methabenzthiazuron
   m. Metobromuron
   n. Metoxuron
   o. Monolinuron
   p. Neburon
   q. Siduron
   r. Tebuthiuron
  2. Amides
   a. Propanil
   b. Pentanochlor
 D. Inhibitors of Photosystem II--HRAC
 Group C3/WSSA Group 6
  1. Nitriles
   a. Bromofenoxim
   b. Bromoxynil
   c. Ioxynil
  2. Benzothiadiazinone (Bentazon)
   a. Bentazon
  3. Phenylpyridazines
   a. Pyridate
   b. Pyridafol
 E. Photosystem-I-electron diversion
 (Bipyridyliums) (WSSA Group 22)
  1. Diquat
  2. Paraquat
 F. Inhibitors of PPO (protoporphyrinogen
 oxidase) (WSSA Group 14)
  1. Diphenylethers
   a. Acifluorfen-Na
   b. Bifenox
   c. Chlomethoxyfen
   d. Fluoroglycofen-ethyl
   e. Fomesafen
   f. Halosafen
   g. Lactofen
   h. Oxyfluorfen
  2. Phenylpyrazoles
   a. Fluazolate
   b. Pyraflufen-ethyl
  3. N-phenylphthalimides
   a. Cinidon-ethyl
   b. Flumioxazin
   c. Flumiclorac-pentyl
  4. Thiadiazoles
   a. Fluthiacet-methyl
   b. Thidiazimin
  5. Oxadiazoles
   a. Oxadiazon
   b. Oxadiargyl
  6. Triazolinones
   a. Carfentrazone-ethyl
   b. Sulfentrazone
  7. Oxazolidinediones
   a. Pentoxazone
  8. Pyrimidindiones
   a. Benzfendizone
   b. Butafenicil
  9. Others
   a. Pyrazogyl
   b. Profluazol
 G. Bleaching: Inhibition of carotenoid
 biosynthesis at the phytoene desaturase step
 (PDS) (WSSA Group 12)
  1. Pyridazinones
   a. Norflurazon
  2. Pyridinecarboxamides
   a. Diflufenican
   b. Picolinafen
  3. Others
   a. Beflubutamid
   b. Fluridone
   c. Flurochloridone
   d. Flurtamone
 H. Bleaching: Inhibition of 4-
 hydroxyphenyl-pyruvate-dioxygenase (4-HPPD)
 (WSSA Group 28)
  1. Triketones
   a. Mesotrione
   b. Sulcotrione
   c. topramezone
   d. tembotrione
  2. Isoxazoles
   a. Pyrasulfotole
   b. Isoxaflutole
  3. Pyrazoles
   a. Benzofenap
   b. Pyrazoxyfen
   c. Pyrazolynate
  4. Others
   a. Benzobicyclon
 I. Bleaching: Inhibition of carotenoid
 biosynthesis (unknown target) (WSSA Group 11
 and 13)
  1. Triazoles (WSSA Group 11)
   a. Amitrole
  2. Isoxazolidinones (WSSA Group 13)
   a. Clomazone TABLE 1-continued Abbreviated version of HRAC Herbicide Classification 3. Ureas
        a. Fluometuron
    3. Diphenylether
        a. Aclonifen
J. Inhibition of EPSP Synthase
    1. Glycines (WSSA Group 9)
        a. Glyphosate
        b. Sulfosate
K. Inhibition of glutamine synthetase
    1. Phosphinic Acids
        a. Glufosinate-ammonium
        b. Bialaphos
L. Inhibition of DHP (dihydropteroate)
   synthase (WSSA Group 18)
    1 Carbamates
        a. Asulam
M. Microtubule Assembly Inhibition
   (WSSA Group 3)
    1. Dinitroanilines
        a. Benfluralin
        b. Butralin
        c. Dinitramine
        d. Ethalfluralin
        e. Oryzalin
        f. Pendimethalin
        g. Trifluralin
    2. Phosphoroamidates
        a. Amiprophos-methyl
        b. Butamiphos
    3. Pyridines
        a. Dithiopyr
        b. Thiazopyr
    4. Benzamides
        a. Pronamide
        b. Tebutam
    5. Benzenedicarboxylic acids
        a. Chlorthal-dimethyl
N. Inhibition of mitosis/microtubule
   organization WSSA Group 23)
    1. Carbamates
        a. Chlorpropham
        b. Propham
        c. Carbetamide
O. Inhibition of cell division (Inhibition of
   very long chain fatty acids as proposed
   mechanism; WSSA Group 15)
    1. Chloroacetamides
        a. Acetochlor
        b. Alachlor
        c. Butachlor
        d. Dimethachlor
        e. Dimethanamid
        f. Metazachlor
        g. Metolachlor
        h. Pethoxamid
        i. Pretilachlor
        j. Propachlor
        k. Propisochlor
        l. Thenylchlor
    2. Acetamides
        a. Diphenamid
        b. Napropamide
        c. Naproanilide
    3. Oxyacetamides
        a. Flufenacet
        b. Mefenacet
    4. Tetrazolinones
        a. Fentrazamide
    5. Others
        a. Anilofos
        b. Cafenstrole
        c. Indanofan
        d. Piperophos
P. Inhibition of cell wall (cellulose)
   synthesis
    1. Nitriles (WSSA Group 20)
        a. Dichlobenil
        b. Chlorthiamid
    2. Benzamides (isoxaben (WSSA
       Group 21))
        a. Isoxaben
    3. Triazolocarboxamides (flupoxam)
        a. Flupoxam
Q. Uncoupling (membrane disruption):
   (WSSA Group 24)
    1. Dinitrophenols
        a. DNOC
        b. Dinoseb
        c. Dinoterb
R. Inhibition of Lipid Synthesis by other
   than ACC inhibition
    1. Thiocarbamates (WSSA Group 8)
        a. Butylate
        b. Cycloate
        c. Dimepiperate
        d. EPTC
        e. Esprocarb
        f. Molinate
        g. Orbencarb
        h. Pebulate
        i. Prosulfocarb
        j. Benthiocarb
        k. Tiocarbazil
        l. Triallate
        m. Vernolate
    2. Phosphorodithioates
        a. Bensulide
    3. Benzofurans
        a. Benfuresate
        b. Ethofumesate
    4. Halogenated alkanoic acids
       (WSSA Group 26)
        a. TCA
        b. Dalapon
        c. Flupropanate
S. Synthetic auxins (IAA-like) (WSSA
   Group 4)
    1. Phenoxycarboxylic acids
        a. Clomeprop
        b. 2,4-D
        c. Mecoprop
    2. Benzoic acids
        a. Dicamba
        b. Chloramben
        c. TBA
    3. Pyridine carboxylic acids
        a. Clopyralid
        b. Fluroxypyr
        c. Picloram
        d. Tricyclopyr
    4. Quinoline carboxylic acids
        a. Quinclorac
        b. Quinmerac
    5. Others (benazolin-ethyl)
        a. Benazolin-ethyl
T. Inhibition of Auxin Transport
    1. Phthalamates; semicarbazones
       (WSSA Group 19)
        a. Naptalam
        b. Diflufenzopyr-Na
U. Other Mechanism of Action
    1. Arylaminopropionic acids
        a. Flamprop-M-methyl/-
           isopropyl
    2. Pyrazolium
        a. Difenzoquat
    3. Organoarsenicals
        a. DSMA
        b. MSMA
    4. Others
        a. Bromobutide
        b. Cinmethylin
        c. Cumyluron
        d. Dazomet
        e. Daimuron-methyl
        f. Dimuron TABLE 1-continued Abbreviated version of HRAC Herbicide Classification g. Etobenzanid
h. Fosamine
i. Metam
j. Oxaziclomefone
k. Oleic acid
l. Pelargonic acid
m. Pyributicarb In still further methods, an HPPD inhibitor can be applied alone or in combination with another herbicide of interest and can be applied to the plants having the HPPD sequence as disclosed herein or their area of cultivation.

Additional herbicide treatment that can be applied over the plant or seeds having the HPPD polypeptides or active variants and fragments thereof include, but are not limited to: acetochlor, acifluorfen and its sodium salt, aclonifen, acrolein (2-propenal), alachlor, alloxydim, ametryn, amicarbazone, amidosulfuron, aminopyralid, amitrole, ammonium sulfamate, anilofos, asulam, atrazine, azimsulfuron, beflubutamid, benazolin, benazolin-ethyl, bencarbazone, benfluralin, benfuresate, bensulfuron-methyl, bensulide, bentazone, benzobicyclon, benzofenap, bifenox, bilanafos, bispyribac and its sodium salt, bromacil, bromobutide, bromofenoxim, bromoxynil, bromoxynil octanoate, butachlor, butafenacil, butamifos, butralin, butroxydim, butylate, cafenstrole, carbetamide, carfentrazone-ethyl, catechin, chlomethoxyfen, chloramben, chlorbromuron, chlorflurenol-methyl, chloridazon, chlorimuron-ethyl, chlorotoluron, chlorpropham, chlorsulfuron, chlorthal-dimethyl, chlorthiamid, cinidon-ethyl, cinmethylin, cinosulfuron, clethodim, clodinafop-propargyl, clomazone, clomeprop, clopyralid, clopyralid-olamine, cloransulam-methyl, CUH-35 (2-methoxyethyl 2-[[[4-chloro-2-fluoro-5-[(1-methyl-2-propynyl)oxy]phenyl](3-fluorobenzoyl)amino]carbonyl]-1-cyclohexene-1-carboxylate), cumyluron, cyanazine, cycloate, cyclosulfamuron, cycloxydim, cyhalofop-butyl, 2,4-D and its butotyl, butyl, isoctyl and isopropyl esters and its dimethylammonium, diolamine and trolamine salts, daimuron, dalapon, dalapon-sodium, dazomet, 2,4-DB and its dimethylammonium, potassium and sodium salts, desmedipham, desmetryn, dicamba and its diglycolammonium, dimethylammonium, potassium and sodium salts, dichlobenil, dichlorprop, diclofop-methyl, diclosulam, difenzoquat metilsulfate, diflufenican, diflufenzopyr, dimefuron, dimepiperate, dimethachlor, dimethametryn, dimethenamid, dimethenamid-P, dimethipin, dimethylarsinic acid and its sodium salt, dinitramine, dinoterb, diphenamid, diquat dibromide, dithiopyr, diuron, DNOC, endothal, EPTC, esprocarb, ethalfluralin, ethametsulfuron-methyl, ethofumesate, ethoxyfen, ethoxysulfuron, etobenzanid, fenoxaprop-ethyl, fenoxaprop-P-ethyl, fentrazamide, fenuron, fenuron-TCA, flamprop-methyl, flamprop-M-isopropyl, flamprop-M-methyl, flazasulfuron, florasulam, fluazifop-butyl, fluazifop-P-butyl, flucarbazone, flucetosulfuron, fluchloralin, flufenacet, flufenpyr, flufenpyr-ethyl, flumetsulam, flumiclorac-pentyl, flumioxazin, fluometuron, fluoroglycofen-ethyl, flupyrsulfuron-methyl and its sodium salt, flurenol, flurenol-butyl, fluridone, flurochloridone, fluroxypyr, flurtamone, fluthiacet-methyl, fomesafen, foramsulfuron, fosamine-ammonium, glufosinate, glufosinate-ammonium, glyphosate and its salts such as ammonium, isopropylammonium, potassium, sodium (including sesquisodium) and trimesium (alternatively named sulfosate) (See, WO2007/024782, herein incorporated by reference), halosulfuron-methyl, haloxyfop-etotyl, haloxyfop-methyl, hexazinone, HOK-201 (N-(2,4-difluorophenyl)-1,5-dihydro-N-(1-methylethyl)-5-oxo-1-[(tetrahydro-2H-pyran-2-yl)methyl]-4H-1,2,4-triazole-4-carboxamide), imazamethabenz-methyl, imazamox, imazapic, imazapyr, imazaquin, imazaquin-ammonium, imazethapyr, imazethapyr-ammonium, imazosulfuron, indanofan, iodosulfuron-methyl, ioxynil, ioxynil octanoate, ioxynil-sodium, isoproturon, isouron, isoxaben, isoxaflutole, pyrasulfotole, lactofen, lenacil, linuron, maleic hydrazide, MCPA and its salts (e.g., MCPA-dimethylammonium, MCPA-potassium and MCPA-sodium, esters (e.g., MCPA-2-ethylhexyl, MCPA-butotyl) and thioesters (e.g., MCPA-thioethyl), MCPB and its salts (e.g., MCPB-sodium) and esters (e.g., MCPB-ethyl), mecoprop, mecoprop-P, mefenacet, mefluidide, mesosulfuron-methyl, mesotrione, metam-sodium, metamifop, metamitron, metazachlor, methabenzthiazuron, methylarsonic acid and its calcium, monoammonium, monosodium and disodium salts, methyldymron, metobenzuron, metobromuron, metolachlor, S-metholachlor, metosulam, metoxuron, metribuzin, metsulfuron-methyl, molinate, monolinuron, naproanilide, napropamide, naptalam, neburon, nicosulfuron, norflurazon, orbencarb, oryzalin, oxadiargyl, oxadiazon, oxasulfuron, oxaziclomefone, oxyfluorfen, paraquat dichloride, pebulate, pelargonic acid, pendimethalin, penoxsulam, pentanochlor, pentoxazone, perfluidone, pethoxyamid, phenmedipham, picloram, picloram-potassium, picolinafen, pinoxaden, piperofos, pretilachlor, primisulfuron-methyl, prodiamine, profoxydim, prometon, prometryn, propachlor, propanil, propaquizafop, propazine, propham, propisochlor, propoxycarbazone, propyzamide, prosulfocarb, prosulfuron, pyraclonil, pyraflufen-ethyl, pyrasulfotole, pyrazogyl, pyrazolynate, pyrazoxyfen, pyrazosulfuron-ethyl, pyribenzoxim, pyributicarb, pyridate, pyriftalid, pyriminobac-methyl, pyrimisulfan, pyrithiobac, pyrithiobac-sodium, pyroxsulam, quinclorac, quinmerac, quinoclamine, quizalofop-ethyl, quizalofop-P-ethyl, quizalofop-P-tefuryl, rimsulfuron, sethoxydim, siduron, simazine, simetryn, sulcotrione, sulfentrazone, sulfometuron-methyl, sulfosulfuron, 2,3,6-TBA, TCA, TCA-sodium, tebutam, tebuthiuron, tefuryltrione, tembotrione, tepraloxydim, terbacil, terbumeton, terbuthylazine, terbutryn, thenylchlor, thiazopyr, thiencarbazone, thifensulfuron-methyl, thiobencarb, tiocarbazil, topramezone, tralkoxydim, tri-allate, triasulfuron, triaziflam, tribenuron-methyl, triclopyr, triclopyr-butotyl, triclopyr-triethylammonium, tridiphane, trietazine, trifloxysulfuron, trifluralin, triflusulfuron-methyl, tritosulfuron and vernolate. Additional herbicides include those that are applied over plants having homogentisate solanesyltransferase (HST) polypeptide such as those described in WO2010029311(A2), herein incorporate by reference it its entirety.

Other suitable herbicides and agricultural chemicals are known in the art, such as, for example, those described in WO 2005/041654. Other herbicides also include bioherbicides such as *Alternaria destruens* Simmons, *Colletotrichum gloeosporiodes* (Penz.) Penz. & Sacc., *Drechsiera monoceras* (MTB-951), *Myrothecium verrucaria* (Albertini & Schweinitz) Ditmar: Fries, *Phytophthora palmivora* (Butl.) Butl. and *Puccinia thlaspeos* Schub. Combinations of various herbicides can result in a greater-than-additive (i.e., synergistic) effect on weeds and/or a less-than-additive effect (i.e. safening) on crops or other desirable plants. In certain instances, combinations of HPPD herbicides with other herbicides having a similar spectrum of control but a different mode of action will be particularly advantageous for preventing the development of resistant weeds.

The time at which a herbicide is applied to an area of interest (and any plants therein) may be important in optimizing weed control. The time at which a herbicide is applied may be determined with reference to the size of plants and/or the stage of growth and/or development of plants in the area of interest, e.g., crop plants or weeds growing in the area.

Ranges of the effective amounts of herbicides can be found, for example, in various publications from University Extension services. See, for example, Bernards et al. (2006) *Guide for Weed Management in Nebraska* (www.ianrpubs.url.edu/sendlt/ec130); Regher et al. (2005) *Chemical Weed Control for Fields Crops, Pastures, Rangeland, and Noncropland*, Kansas State University Agricultural Extension Station and Corporate Extension Service; Zollinger et al. (2006) *North Dakota Weed Control Guide*, North Dakota Extension Service, and the Iowa State University Extension at www.weeds.iastate.edu, each of which is herein incorporated by reference.

Many plant species can be controlled (i.e., killed or damaged) by the herbicides described herein. Accordingly, the methods of the invention are useful in controlling these plant species where they are undesirable (i.e., where they are weeds). These plant species include crop plants as well as species commonly considered weeds, including but not limited to species such as: blackgrass (*Alopecurus myosuroides*), giant foxtail (*Setaria faberi*), large crabgrass (*Digitaria sanguinalis*), Surinam grass (*Brachiaria decumbens*), wild oat (*Avena fatua*), common cocklebur (*Xanthium pensylvanicum*), common lambsquarters (*Chenopodium album*), morning glory (*Ipomoea coccinea*), pigweed (*Amaranthus* spp.), velvetleaf (*Abutilion theophrasti*), common barnyardgrass (*Echinochloa crus-galli*), bermudagrass (*Cynodon dactylon*), downy brome (*Bromus tectorum*), goosegrass (*Eleusine indica*), green foxtail (*Setaria viridis*), Italian ryegrass (*Lolium multiflorum*), Johnsongrass (*Sorghum halepense*), lesser canarygrass (*Phalaris minor*), windgrass (*Apera spicaventi*), wooly cupgrass (*Erichloa villosa*), yellow nutsedge (*Cyperus esculentus*), common chickweed (*Stellaria media*), common ragweed (*Ambrosia artemisiifolia*), Kochia scoparia, horseweed (*Conyza canadensis*), rigid ryegrass (*Lolium rigidum*), goosegrass (*Eleucine indica*), hairy fleabane (*Conyza bonariensis*), buckhorn plantain (*Plantago lanceolata*), tropical spiderwort (*Commelina benghalensis*), field bindweed (*Convolvulus arvensis*), purple nutsedge (*Cyperus rotundus*), redvine (*Brunnichia ovata*), hemp sesbania (*Sesbania exaltata*), sicklepod (*Senna obtusifolia*), Texas blueweed (*Helianthus ciliaris*), and Devil's claws (*Proboscidea louisianica*). In other embodiments, the weed comprises a herbicide-resistant ryegrass, for example, a glyphosate resistant ryegrass, a paraquat resistant ryegrass, a ACCase-inhibitor resistant ryegrass, and a non-selective herbicide resistant ryegrass.

In some embodiments, a plant having the HPPD sequence disclosed herein or active variants and fragments thereof is not significantly damaged by treatment with an HPPD inhibitor applied to that plant, whereas an appropriate control plant is significantly damaged by the same treatment.

Generally, an HPPD inhibitor is applied to a particular field (and any plants growing in it) no more than 1, 2, 3, 4, 5, 6, 7, or 8 times a year, or no more than 1, 2, 3, 4, or 5 times per growing season.

Thus, methods of the invention encompass applications of herbicide which are "preemergent," "postemergent," "pre-plant incorporation" and/or which involve seed treatment prior to planting.

In one embodiment, methods are provided for coating seeds. The methods comprise coating a seed with an effective amount of a herbicide or a combination of herbicides (as disclosed elsewhere herein). The seeds can then be planted in an area of cultivation. Further provided are seeds having a coating comprising an effective amount of a herbicide or a combination of herbicides (as disclosed elsewhere herein). In other embodiments, the seeds can be coated with at least one fungicide and/or at least one insecticide and/or at least one herbicide or any combination thereof "Preemergent" refers to a herbicide which is applied to an area of interest (e.g., a field or area of cultivation) before a plant emerges visibly from the soil. "Postemergent" refers to a herbicide which is applied to an area after a plant emerges visibly from the soil. In some instances, the terms "preemergent" and "postemergent" are used with reference to a weed in an area of interest, and in some instances these terms are used with reference to a crop plant in an area of interest. When used with reference to a weed, these terms may apply to only a particular type of weed or species of weed that is present or believed to be present in the area of interest. While any herbicide may be applied in a preemergent and/or postemergent treatment, some herbicides are known to be more effective in controlling a weed or weeds when applied either preemergence or postemergence. For example, rimsulfuron has both preemergence and postemergence activity, while other herbicides have predominately preemergence (metolachlor) or postemergence (glyphosate) activity. These properties of particular herbicides are known in the art and are readily determined by one of skill in the art. Further, one of skill in the art would readily be able to select appropriate herbicides and application times for use with the transgenic plants of the invention and/or on areas in which transgenic plants of the invention are to be planted. "Preplant incorporation" involves the incorporation of compounds into the soil prior to planting.

Thus, improved methods of growing a crop and/or controlling weeds such as, for example, "pre-planting burn down," are provided wherein an area is treated with herbicides prior to planting the crop of interest in order to better control weeds. The invention also provides methods of growing a crop and/or controlling weeds which are "no-till" or "low-till" (also referred to as "reduced tillage"). In such methods, the soil is not cultivated or is cultivated less frequently during the growing cycle in comparison to traditional methods; these methods can save costs that would otherwise be incurred due to additional cultivation, including labor and fuel costs.

The term "safener" refers to a substance that when added to a herbicide formulation eliminates or reduces the phytotoxic effects of the herbicide to certain crops. One of ordinary skill in the art would appreciate that the choice of safener depends, in part, on the crop plant of interest and the particular herbicide or combination of herbicides. Exemplary safeners suitable for use with the presently disclosed herbicide compositions include, but are not limited to, those disclosed in U.S. Pat. Nos. 4,808,208; 5,502,025; 6,124,240 and U.S. Patent Application Publication Nos. 2006/0148647; 2006/0030485; 2005/0233904; 2005/0049145; 2004/0224849; 2004/0224848; 2004/0224844; 2004/0157737; 2004/0018940; 2003/0171220; 2003/0130120; 2003/0078167, the disclosures of which are incorporated herein by reference in their entirety. The methods of the invention can involve the use of herbicides in combination with herbicide safeners such as benoxacor, BCS (1-bromo-4-[(chloromethyl) sulfonyl]benzene), cloquintocet-mexyl, cyometrinil, dichlormid, 2-(dichloromethyl)-2-methyl-1,3-dioxolane (MG 191), fenchlorazole-ethyl, fenclorim, flurazole, fluxofenim, furilazole, isoxadifen-ethyl, mefenpyr-diethyl, methoxyphenone ((4-methoxy-3-methylphenyl)(3-methylphenyl)-methanone), naphthalic anhydride (1,8-naphthalic anhydride) and oxabetrinil to increase crop safety. Antidotally effective amounts of the herbicide safeners can be applied at the same time as the compounds of this invention, or applied as seed treatments. Therefore an aspect of the present invention relates to the use of a mixture comprising an HPPD inhibitor, at least one other herbicide, and an antidotally effective amount of a herbicide safener.

Seed treatment is useful for selective weed control, because it physically restricts antidoting to the crop plants. Therefore in one embodiment, a method for selectively controlling the growth of weeds in a field comprising treating the seed from which the crop is grown with an antidotally effective amount of safener and treating the field with an effective amount of herbicide to control weeds.

An antidotally effective amount of a safener is present where a desired plant is treated with the safener so that the effect of a herbicide on the plant is decreased in comparison to the effect of the herbicide on a plant that was not treated with the safener; generally, an antidotally effective amount of safener prevents damage or severe damage to the plant treated with the safener. One of skill in the art is capable of determining whether the use of a safener is appropriate and determining the dose at which a safener should be administered to a crop.

As used herein, an "adjuvant" is any material added to a spray solution or formulation to modify the action of an agricultural chemical or the physical properties of the spray solution. See, for example, Green and Foy (2003) "Adjuvants: Tools for Enhancing Herbicide Performance," in Weed Biology and Management, ed. Inderjit (Kluwer Academic Publishers, The Netherlands). Adjuvants can be categorized or subclassified as activators, acidifiers, buffers, additives, adherents, antiflocculants, antifoamers, defoamers, antifreezes, attractants, basic blends, chelating agents, cleaners, colorants or dyes, compatibility agents, cosolvents, couplers, crop oil concentrates, deposition agents, detergents, dispersants, drift control agents, emulsifiers, evaporation reducers, extenders, fertilizers, foam markers, formulants, inerts, humectants, methylated seed oils, high load COCs, polymers, modified vegetable oils, penetrators, repellants, petroleum oil concentrates, preservatives, rainfast agents, retention aids, solubilizers, surfactants, spreaders, stickers, spreader stickers, synergists, thickeners, translocation aids, uv protectants, vegetable oils, water conditioners, and wetting agents.

In addition, methods of the invention can comprise the use of a herbicide or a mixture of herbicides, as well as, one or more other insecticides, fungicides, nematocides, bactericides, acaricides, growth regulators, chemosterilants, semiochemicals, repellents, attractants, pheromones, feeding stimulants or other biologically active compounds or entomopathogenic bacteria, virus, or fungi to form a multi-component mixture giving an even broader spectrum of agricultural protection. Examples of such agricultural protectants which can be used in methods of the invention include: insecticides such as abamectin, acephate, acetamiprid, amidoflumet (S-1955), avermectin, azadirachtin, azinphos-methyl, bifenthrin, bifenazate, buprofezin, carbofuran, cartap, chlorfenapyr, chlorfluazuron, chlorpyrifos, chlorpyrifos-methyl, chromafenozide, clothianidin, cyflumetofen, cyfluthrin, beta-cyfluthrin, cyhalothrin, lambda-cyhalothrin, cypermethrin, cyromazine, deltamethrin, diafenthiuron, diazinon, dieldrin, diflubenzuron, dimefluthrin, dimethoate, dinotefuran, diofenolan, emamectin, endosulfan, esfenvalerate, ethiprole, fenothiocarb, fenoxycarb, fenpropathrin, fenvalerate, fipronil, flonicamid, flubendiamide, flucythrinate, tau-fluvalinate, flufenerim (UR-50701), flufenoxuron, fonophos, halofenozide, hexaflumuron, hydramethylnon, imidacloprid, indoxacarb, isofenphos, lufenuron, malathion, metaflumizone, metaldehyde, methamidophos, methidathion, methomyl, methoprene, methoxychlor, metofluthrin, monocrotophos, methoxyfenozide, nitenpyram, nithiazine, novaluron, noviflumuron (XDE-007), oxamyl, parathion, parathion-methyl, permethrin, phorate, phosalone, phosmet, phosphamidon, pirimicarb, profenofos, profluthrin, pymetrozine, pyrafluprole, pyrethrin, pyridalyl, pyriprole, pyriproxyfen, rotenone, ryanodine, spinosad, spirodiclofen, spiromesifen (BSN 2060), spirotetramat, sulprofos, tebufenozide, teflubenzuron, tefluthrin, terbufos, tetrachlorvinphos, thiacloprid, thiamethoxam, thiodicarb, thiosultap-sodium, tralomethrin, triazamate, trichlorfon and triflumuron; fungicides such as acibenzolar, aldimorph, amisulbrom, azaconazole, azoxystrobin, benalaxyl, benomyl, benthiavalicarb, benthiavalicarb-isopropyl, binomial, biphenyl, bitertanol, blasticidin-S, Bordeaux mixture (Tribasic copper sulfate), boscalid/nicobifen, bromuconazole, bupirimate, buthiobate, carboxin, carpropamid, captafol, captan, carbendazim, chloroneb, chlorothalonil, chlozolinate, clotrimazole, copper oxychloride, copper salts such as copper sulfate and copper hydroxide, cyazofamid, cyflunamid, cymoxanil, cyproconazole, cyprodinil, dichlofluanid, diclocymet, diclomezine, dicloran, diethofencarb, difenoconazole, dimethomorph, dimoxystrobin, diniconazole, diniconazole-M, dinocap, discostrobin, dithianon, dodemorph, dodine, econazole, etaconazole, edifenphos, epoxiconazole, ethaboxam, ethirimol, ethridiazole, famoxadone, fenamidone, fenarimol, fenbuconazole, fencaramid, fenfuram, fenhexamide, fenoxanil, fenpiclonil, fenpropidin, fenpropimorph, fentin acetate, fentin hydroxide, ferbam, ferfurazoate, ferimzone, fluazinam, fludioxonil, flumetover, fluopicolide, fluoxastrobin, fluquinconazole, fluquinconazole, flusilazole, flusulfamide, flutolanil, flutriafol, folpet, fosetyl-aluminum, fuberidazole, furalaxyl, furametapyr, hexaconazole, hymexazole, guazatine, imazalil, imibenconazole, iminoctadine, iodicarb, ipconazole, iprobenfos, iprodione, iprovalicarb, isoconazole, isoprothiolane, kasugamycin, kresoxim-methyl, mancozeb, mandipropamid, maneb, mapanipyrin, mefenoxam, mepronil, metalaxyl, metconazole, methasulfocarb, metiram, metominostrobin/fenominostrobin, mepanipyrim, metrafenone, miconazole, myclobutanil, neo-asozin (ferric methanearsonate), nuarimol, octhilinone, ofurace, orysastrobin, oxadixyl, oxolinic acid, oxpoconazole, oxycarboxin, paclobutrazol, penconazole, pencycuron, penthiopyrad, perfurazoate, phosphonic acid, phthalide, picobenzamid, picoxystrobin, polyoxin, probenazole, prochloraz, procymidone, propamocarb, propamocarb-hydrochloride, propiconazole, propineb, proquinazid, prothioconazole, pyraclostrobin, pryazophos, pyrifenox, pyrimethanil, pyrifenox, pyrolnitrine, pyroquilon, quinconazole, quinoxyfen, quintozene, silthiofam, simeconazole, spiroxamine, streptomycin, sulfur, tebuconazole, techrazene, tecloftalam, tecnazene, tetraconazole, thiabendazole, thifluzamide, thiophanate, thiophanate-methyl, thiram, tiadinil, tolclofos-methyl, tolyfluanid, triadimefon, triadimenol, triarimol, triazoxide, tridemorph, trimoprhamide tricyclazole, trifloxystrobin, triforine, triticonazole, uniconazole, validamycin, vinclozolin, zineb, ziram, and zoxamide; nematocides such as aldicarb, oxamyl and fenamiphos; bactericides such as streptomycin; acaricides such as amitraz, chinomethionat, chlorobenzilate, cyhexatin, dicofol, dienochlor, etoxazole, fenazaquin, fenbutatin oxide, fenpropathrin, fenpyroximate, hexythiazox, propargite, pyridaben and tebufenpyrad; and biological agents including entomopathogenic bacteria, such as *Bacillus thuringiensis* subsp. *Aizawai, Bacillus thuringiensis* subsp. *Kurstaki*, and the encapsulated delta-endotoxins of *Bacillus thuringiensis* (e.g., Cellcap, MPV, MPVII); entomopathogenic fungi, such as green muscardine fungus; and entomopathogenic virus including baculovirus, nucleopolyhedro virus (NPV) such as HzNPV, AfNPV; and granulosis virus (GV) such as CpGV.

The methods of controlling weeds can further include the application of a biologically effective amount of a herbicide of interest or a mixture of herbicides, and an effective amount of at least one additional biologically active compound or agent and can further comprise at least one of a surfactant, a solid diluent or a liquid diluent. Examples of such biologically active compounds or agents are: insecticides such as abamectin, acephate, acetamiprid, amidoflumet (S-1955), avermectin, azadirachtin, azinphos-methyl, bifenthrin, binfenazate, buprofezin, carbofuran, chlorfenapyr, chlorfluazuron, chlorpyrifos, chlorpyrifos-methyl, chromafenozide, clothianidin, cyfluthrin, beta-cyfluthrin, cyhalothrin, lambda-cyhalothrin, cypermethrin, cyromazine, deltamethrin, diafenthiuron, diazinon, diflubenzuron, dimethoate, diofenolan, emamectin, endosulfan, esfenvalerate, ethiprole, fenothicarb, fenoxycarb, fenpropathrin, fenvalerate, fipronil, flonicamid, flucythrinate, tau-fluvalinate, flufenerim (UR-50701), flufenoxuron, fonophos, halofenozide, hexaflumuron, imidacloprid, indoxacarb, isofenphos, lufenuron, malathion, metaldehyde, methamidophos, methidathion, methomyl, methoprene, methoxychlor, monocrotophos, methoxyfenozide, nithiazin, novaluron, noviflumuron (XDE-007), oxamyl, parathion, parathion-methyl, permethrin, phorate, phosalone, phosmet, phosphamidon, pirimicarb, profenofos, pymetrozine, pyridalyl, pyriproxyfen, rotenone, spinosad, spiromesifin (BSN 2060), sulprofos, tebufenozide, teflubenzuron, tefluthrin, terbufos, tetrachlorvinphos, thiacloprid, thiamethoxam, thiodicarb, thiosultap-sodium, tralomethrin, trichlorfon and triflumuron; fungicides such as acibenzolar, azoxystrobin, benomyl, blasticidin-S, Bordeaux mixture (tribasic copper sulfate), bromuconazole, carpropamid, captafol, captan, carbendazim, chloroneb, chlorothalonil, copper oxychloride, copper salts, cyflufenamid, cymoxanil, cyproconazole, cyprodinil, (S)-3,5-dichloro-N-(3-chloro-1-ethyl-1-methyl-2-oxopropyl)-4-methylbenzamide (RH 7281), diclocymet (S-2900), diclomezine, dicloran, difenoconazole, (S)-3,5-dihydro-5-methyl-2-(methylthio)-5-phenyl-3-(phenyl-amino)-4H-imidazol-4-one (RP 407213), dimethomorph, dimoxystrobin, diniconazole, diniconazole-M, dodine, edifenphos, epoxiconazole, famoxadone, fenamidone, fenarimol, fenbuconazole, fencaramid (SZX0722), fenpiclonil, fenpropidin, fenpropimorph, fentin acetate, fentin hydroxide, fluazinam, fludioxonil, flumetover (RPA 403397), flumorf/flumorlin (SYP-L190), fluoxastrobin (HEC 5725), fluquinconazole, flusilazole, flutolanil, flutriafol, folpet, fosetyl-aluminum, furalaxyl, furametapyr (S-82658), hexaconazole, ipconazole, iprobenfos, iprodione, isoprothiolane, kasugamycin, kresoxim-methyl, mancozeb, maneb, mefenoxam, mepronil, metalaxyl, metconazole, metominostrobin/fenominostrobin (SSF-126), metrafenone (AC375839), myclobutanil, neo-asozin (ferric methane-arsonate), nicobifen (BAS 510), orysastrobin, oxadixyl, penconazole, pencycuron, probenazole, prochloraz, propamocarb, propiconazole, proquinazid (DPX-KQ926), prothioconazole (JAU 6476), pyrifenox, pyraclostrobin, pyrimethanil, pyroquilon, quinoxyfen, spiroxamine, sulfur, tebuconazole, tetraconazole, thiabendazole, thifluzamide, thiophanate-methyl, thiram, tiadinil, triadimefon, triadimenol, tricyclazole, trifloxystrobin, triticonazole, validamycin and vinclozolin; nematocides such as aldicarb, oxamyl and fenamiphos; bactericides such as streptomycin; acaricides such as amitraz, chinomethionat, chlorobenzilate, cyhexatin, dicofol, dienochlor, etoxazole, fenazaquin, fenbutatin oxide, fenpropathrin, fenpyroximate, hexythiazox, propargite, pyridaben and tebufenpyrad; and biological agents including entomopathogenic bacteria, such as *Bacillus thuringiensis* subsp. *Aizawai, Bacillus thuringiensis* subsp. *Kurstaki,* and the encapsulated delta-endotoxins of *Bacillus thuringiensis* (e.g., Cellcap, MPV, MPVII); entomopathogenic fungi, such as green muscardine fungus; and entomopathogenic virus including baculovirus, nucleopolyhedro virus (NPV) such as HzNPV, AfNPV; and granulosis virus (GV) such as CpGV. Methods of the invention may also comprise the use of plants genetically transformed to express proteins (such as *Bacillus thuringiensis* delta-endotoxins) toxic to invertebrate pests. In such embodiments, the effect of exogenously applied invertebrate pest control compounds may be synergistic with the expressed toxin proteins. General references for these agricultural protectants include *The Pesticide Manual*, 13*th Edition*, C. D. S. Tomlin, Ed., British Crop Protection Council, Farnham, Surrey, U.K., 2003 and *The BioPesticide Manual*, $2^{nd}$ *Edition*, L. G. Copping, Ed., British Crop Protection Council, Farnham, Surrey, U.K., 2001.

In certain instances, combinations with other invertebrate pest control compounds or agents having a similar spectrum of control but a different mode of action will be particularly advantageous for resistance management. Thus, compositions of the present invention can further comprise a biologically effective amount of at least one additional invertebrate pest control compound or agent having a similar spectrum of control but a different mode of action. Contacting a plant genetically modified to express a plant protection compound (e.g., protein) or the locus of the plant with a biologically effective amount of a compound of this invention can also provide a broader spectrum of plant protection and be advantageous for resistance management.

Thus, methods of controlling weeds can employ a herbicide or herbicide combination and may further comprise the use of insecticides and/or fungicides, and/or other agricultural chemicals such as fertilizers. The use of such combined treatments of the invention can broaden the spectrum of activity against additional weed species and suppress the proliferation of any resistant biotypes.

Methods can further comprise the use of plant growth regulators such as aviglycine, N-(phenylmethyl)-1H-purin-6-amine, ethephon, epocholeone, gibberellic acid, gibberellin $A_4$ and $A_7$, harpin protein, mepiquat chloride, prohexadione calcium, prohydrojasmon, sodium nitrophenolate and trinexapac-methyl, and plant growth modifying organisms such as *Bacillus cereus* strain BP01.

C. Method of Detections

Methods for detecting an HPPD polypeptide or an active variant or fragment thereof are provided. Such methods comprise analyzing plant tissues to detect such polypeptides or the polynucleotides encoding the same. The detection methods can directly assay for the presence of the HPPD polypeptide or polynucleotide or the detection methods can indirectly assay for the sequences by assaying the phenotype of the cell plant, plant cell or plant explant expressing the sequence.

In one embodiment, the HPPD polypeptide is detected in the plant tissue using an immunoassay comprising an antibody or antibodies that specifically recognizes an HPPD polypeptide or active variant or fragment thereof. In specific embodiments, the antibody or antibodies which are used are raised to an HPPD polypeptide or active variant or fragment thereof as disclosed herein.

By "specifically or selectively binds" is intended that the binding agent has a binding affinity for a given HPPD polypeptide or fragment or variant disclosed herein, which is greater than 10%, 9%, 8%, 7%, 6%, 5%, 4%, 3%, 2% or 1% of the binding affinity for a known HPPD sequence. One of skill will be aware of the proper controls that are needed to carry out such a determination By "antibodies that specifically bind" is intended that the antibodies will not substantially cross react with another polypeptide. By "not substantially cross react" is intended that the antibody or fragment thereof has a binding affinity for the other polypeptide which is less than 10%, less than 5%, or less than 1%, of the binding affinity for the HPPD polypeptide or active fragment or variant thereof.

In still other embodiments, the HPPD polypeptide or active variant or fragment thereof can be detected in a plant tissue by detecting the presence of a polynucleotide encoding any of the various HPPD polypeptides or active variants and fragments thereof. In one embodiment, the detection method comprises assaying plant tissue using PCR amplification.

As used herein, "primers" are isolated polynucleotides that are annealed to a complementary target DNA strand by nucleic acid hybridization to form a hybrid between the primer and the target DNA strand, then extended along the target DNA strand by a polymerase, e.g., a DNA polymerase. Primer pairs of the invention refer to their use for amplification of a target polynucleotide, e.g., by the polymerase chain reaction (PCR) or other conventional nucleic-acid amplification methods. "PCR" or "polymerase chain reaction" is a technique used for the amplification of specific DNA segments (see, U.S. Pat. Nos. 4,683,195 and 4,800,159; herein incorporated by reference).

Probes and primers are of sufficient nucleotide length to bind to the target DNA sequence and specifically detect and/or identify a polynucleotide encoding an HPPD polypeptide or active variant or fragment thereof as describe elsewhere herein. It is recognized that the hybridization conditions or reaction conditions can be determined by the operator to achieve this result. This length may be of any length that is of sufficient length to be useful in a detection method of choice. Such probes and primers can hybridize specifically to a target sequence under high stringency hybridization conditions. Probes and primers according to embodiments of the present invention may have complete DNA sequence identity of contiguous nucleotides with the target sequence, although probes differing from the target DNA sequence and that retain the ability to specifically detect and/or identify a target DNA sequence may be designed by conventional methods. Accordingly, probes and primers can share about 80%, 85%, 90%, 91%, 92%, 93%, 94%, 95%, 96%, 97%, 98%, 99% or greater sequence identity or complementarity to the target polynucleotide.

Methods for preparing and using probes and primers are described, for example, in *Molecular Cloning: A Laboratory Manual*, 2.sup.nd ed, vol. 1-3, ed. Sambrook et al., Cold Spring Harbor Laboratory Press, Cold Spring Harbor, N.Y. 1989 (hereinafter, "Sambrook et al., 1989"); *Current Protocols in Molecular Biology*, ed. Ausubel et al., Greene Publishing and Wiley-Interscience, New York, 1992 (with periodic updates) (hereinafter, "Ausubel et al., 1992"); and Innis et al., PCR Protocols: A Guide to Methods and Applications, Academic Press: San Diego, 1990. PCR primer pairs can be derived from a known sequence, for example, by using computer programs intended for that purpose such as the PCR primer analysis tool in Vector NTI version 10 (Invitrogen); PrimerSelect (DNASTAR Inc., Madison, Wis.); and Primer (Version 0.5.COPYRGT., 1991, Whitehead Institute for Biomedical Research, Cambridge, Mass.). Additionally, the sequence can be visually scanned and primers manually identified using guidelines known to one of skill in the art.

D. Method of Identifying HPPD Variants

Various methods can be employed to identify further HPPD variants. The polynucleotides of the invention are optionally used as substrates for a variety of diversity generating procedures, e.g., mutation, recombination and recursive recombination reactions, in addition to their use in standard cloning methods as set forth in, e.g., Ausubel, Berger and Sambrook, i.e., to produce additional HPPD polynucleotides and polypeptides with desired properties. A variety of diversity generating protocols can be used. The procedures can be used separately, and/or in combination to produce one or more variants of a polynucleotide or set of polynucleotides, as well variants of encoded proteins. Individually and collectively, these procedures provide robust, widely applicable ways of generating diversified polynucleotides and sets of polynucleotides (including, e.g., polynucleotide libraries) useful, e.g., for the engineering or rapid evolution of polynucleotides, proteins, pathways, cells and/or organisms with new and/or improved characteristics. The process of altering the sequence can result in, for example, single nucleotide substitutions, multiple nucleotide substitutions, and insertion or deletion of regions of the nucleic acid sequence.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more polynucleotides, which can be selected or screened for polynucleotides that encode proteins with or which confer desirable properties. Following diversification by one or more of the methods herein, or otherwise available to one of skill, any polynucleotides that are produced can be selected for a desired activity or property, e.g. altered Km, use of alternative cofactors, increased kcat, etc. This can include identifying any activity that can be detected, for example, in an automated or automatable format, by any of the assays in the art. For example, modified HPPD polypeptides can be detected by assaying for an increased insensitivity to HPPD inhibitor. Assays to measure such activity are described elsewhere herein. A variety of related (or even unrelated) properties can be evaluated, in serial or in parallel, at the discretion of the practitioner.

Descriptions of a variety of diversity generating procedures, including family shuffling and methods for generating modified nucleic acid sequences encoding multiple enzymatic domains, are found in the following publications and the references cited therein: Soong N. et al. (2000) *Nat Genet* 25(4):436-39; Stemmer et al. (1999) *Tumor Targeting* 4:1-4; Ness et al. (1999) *Nature Biotechnology* 17:893-896; Chang et al. (1999) *Nature Biotechnology* 17:793-797; Minshull and Stemmer (1999) *Current Opinion in Chemical Biology* 3:284-290; Christians et al. (1999) *Nature Biotechnology* 17:259-264; Crameri et al. (1998) *Nature* 391:288-291; Crameri et al. (1997) *Nature Biotechnology* 15:436-438; Zhang et al. (1997) *Proc. Natl. Acad. Sci. USA* 94:4504-4509; Patten et al. (1997) *Current Opinion in Biotechnology* 8:724-733; Crameri et al. (1996) *Nature Medicine* 2:100-103; Crameri et al. (1996) *Nature Biotechnology* 14:315-319; Gates et al. (1996) *Journal of Molecular Biology* 255:373-386; Stemmer (1996) "Sexual PCR and Assembly PCR" In: The Encyclopedia of Molecular Biology. VCH Publishers, New York. pp. 447-457; Crameri and Stemmer (1995) *BioTechniques* 18:194-195; Stemmer et al. (1995) *Gene:* 164:49-

53; Stemmer (1995) *Science* 270: 1510; Stemmer (1995) *Bio/Technology* 13:549-553; Stemmer (1994) *Nature* 370: 389-391; and Stemmer (1994) *Proc. Natl. Acad. Sci. USA* 91:10747-10751. See also WO2008/073877 and US 20070204369, both of which are herein incorporated by reference in their entirety.

Mutational methods of generating diversity include, for example, site-directed mutagenesis (Ling et al. (1997) *Anal Biochem.* 254(2): 157-178; Dale et al. (1996) *Methods Mol. Biol.* 57:369-374; Smith (1985) *Ann. Rev. Genet.* 19:423-462; Botstein & Shortie (1985) *Science* 229:1193-1201; Carter (1986) *Biochem. J.* 237:1-7; and Kunkel (1987) Nucleic Acids & Molecular Biology (Eckstein, F. and Lilley, D. M. J. eds., Springer Verlag, Berlin)); mutagenesis using uracil containing templates (Kunkel (1985) *Proc. Natl. Acad. Sci. USA* 82:488-492; Kunkel et al. (1987) *Methods in Enzymol.* 154, 367-382; and Bass et al. (1988) *Science* 242:240-245); oligonucleotide-directed mutagenesis (*Methods in Enzymol.* 100: 468-500 (1983); *Methods in Enzymol.* 154: 329-350 (1987); Zoller & Smith (1982) *Nucleic Acids Res.* 10:6487-6500; Zoller & Smith (1983) *Methods in Enzymol.* 100:468-500; and Zoller & Smith (1987) *Methods in Enzymol.* 154:329-350); phosphorothioate-modified DNA mutagenesis (Taylor et al. (1985) *Nucl. Acids Res.* 13: 8749-8764; Taylor et al. (1985) *Nucl. Acids Res.* 13: 8765-8787 (1985); Nakamaye & Eckstein (1986) *Nucl. Acids Res.* 14: 9679-9698; Sayers et al. (1988) *Nucl. Acids Res.* 16:791-802; and Sayers et al. (1988) *Nucl. Acids Res.* 16: 803-814); mutagenesis using gapped duplex DNA (Kramer et al. (1984) *Nucl. Acids Res.* 12: 9441-9456; Kramer & Fritz (1987) *Methods in Enzymol.* 154:350-367; Kramer et al. (1988) *Nucl. Acids Res.* 16: 7207; and Fritz et al. (1988) *Nucl. Acids Res.* 16: 6987-6999).

Additional suitable methods include, but are not limited to, point mismatch repair (Kramer et al. (1984) *Cell* 38:879-887), mutagenesis using repair-deficient host strains (Carter et al. (1985) *Nucl. Acids Res.* 13: 4431-4443; and Carter (1987) *Methods in Enzymol.* 154: 382-403), deletion mutagenesis (Eghtedarzadeh & Henikoff (1986) *Nucl. Acids Res.* 14: 5115), restriction-selection and restriction-purification (Wells et al. (1986) *Phil. Trans. R. Soc. Lond. A* 317: 415-423), mutagenesis by total gene synthesis (Nambiar et al. (1984) *Science* 223: 1299-1301; Sakamar and Khorana (1988) *Nucl. Acids Res.* 14: 6361-6372; Wells et al. (1985) *Gene* 34:315-323; and Grundström et al. (1985) *Nucl. Acids Res.* 13: 3305-3316), and double-strand break repair (Mandecki (1986); Arnold (1993) *Current Opinion in Biotechnology* 4:450-455 and *Proc. Natl. Acad. Sci.* USA, 83:7177-7181). Additional details on many of the above methods can be found in *Methods in Enzymology* Volume 154, which also describes useful controls for trouble-shooting problems with various mutagenesis methods.

Additional details regarding various diversity generating methods can be found in the following U.S. patents, PCT publications, and EPO publications: U.S. Pat. No. 5,605,793, U.S. Pat. No. 5,811,238, U.S. Pat. No. 5,830,721, U.S. Pat. No. 5,834,252, U.S. Pat. No. 5,837,458, WO 95/22625, WO 96/33207, WO 97/20078, WO 97/35966, WO 99/41402, WO 99/41383, WO 99/41369, WO 99/41368, EP 752008, EP 0932670, WO 99/23107, WO 99/21979, WO 98/31837, WO 98/27230, WO 98/13487, WO 00/00632, WO 00/09679, WO 98/42832, WO 99/29902, WO 98/41653, WO 98/41622, WO 98/42727, WO 00/18906, WO 00/04190, WO 00/42561, WO 00/42559, WO 00/42560, WO 01/23401, and, PCT/US01/06775. See, also WO20074303, herein incorporated by reference.

In brief, several different general classes of sequence modification methods, such as mutation, recombination, etc. are applicable to the present invention and set forth, e.g., in the references above. That is, alterations to the component nucleic acid sequences to produced modified gene fusion constructs can be performed by any number of the protocols described, either before cojoining of the sequences, or after the cojoining step. The following exemplify some of the different types of preferred formats for diversity generation in the context of the present invention, including, e.g., certain recombination based diversity generation formats.

Nucleic acids can be recombined in vitro by any of a variety of techniques discussed in the references above, including e.g., DNAse digestion of nucleic acids to be recombined followed by ligation and/or PCR reassembly of the nucleic acids. For example, sexual PCR mutagenesis can be used in which random (or pseudo random, or even non-random) fragmentation of the DNA molecule is followed by recombination, based on sequence similarity, between DNA molecules with different but related DNA sequences, in vitro, followed by fixation of the crossover by extension in a polymerase chain reaction. This process and many process variants are described in several of the references above, e.g., in Stemmer (1994) *Proc. Natl. Acad. Sci.* USA 91:10747-10751.

Similarly, nucleic acids can be recursively recombined in vivo, e.g., by allowing recombination to occur between nucleic acids in cells. Many such in vivo recombination formats are set forth in the references noted above. Such formats optionally provide direct recombination between nucleic acids of interest, or provide recombination between vectors, viruses, plasmids, etc., comprising the nucleic acids of interest, as well as other formats. Details regarding such procedures are found in the references noted above.

Whole genome recombination methods can also be used in which whole genomes of cells or other organisms are recombined, optionally including spiking of the genomic recombination mixtures with desired library components (e.g., genes corresponding to the pathways of the present invention). These methods have many applications, including those in which the identity of a target gene is not known. Details on such methods are found, e.g., in WO 98/31837 and in PCT/US99/15972. Thus, any of these processes and techniques for recombination, recursive recombination, and whole genome recombination, alone or in combination, can be used to generate the modified nucleic acid sequences and/or modified gene fusion constructs of the present invention.

Synthetic recombination methods can also be used, in which oligonucleotides corresponding to targets of interest are synthesized and reassembled in PCR or ligation reactions which include oligonucleotides which correspond to more than one parental nucleic acid, thereby generating new recombined nucleic acids. Oligonucleotides can be made by standard nucleotide addition methods, or can be made, e.g., by tri-nucleotide synthetic approaches. Details regarding such approaches are found in the references noted above, including, e.g., WO 00/42561, WO 01/23401, WO 00/42560, and, WO 00/42559.

In silico methods of recombination can be affected in which genetic algorithms are used in a computer to recombine sequence strings which correspond to homologous (or even non-homologous) nucleic acids. The resulting recombined sequence strings are optionally converted into nucleic acids by synthesis of nucleic acids which correspond to the recombined sequences, e.g., in concert with oligonucleotide synthesis/gene reassembly techniques. This approach can generate random, partially random or designed variants. Many details regarding in silico recombination, including the use of genetic algorithms, genetic operators and the like in computer systems, combined with generation of corresponding nucleic acids (and/or proteins), as well as combinations of designed nucleic acids and/or proteins (e.g., based on crossover site selection) as well as designed, pseudo-random or random recombination methods are described in WO 00/42560 and WO 00/42559.

Many methods of accessing natural diversity, e.g., by hybridization of diverse nucleic acids or nucleic acid fragments to single-stranded templates, followed by polymerization and/or ligation to regenerate full-length sequences, optionally followed by degradation of the templates and recovery of the resulting modified nucleic acids can be similarly used. In one method employing a single-stranded template, the fragment population derived from the genomic library(ies) is annealed with partial, or, often approximately full length ssDNA or RNA corresponding to the opposite strand. Assembly of complex chimeric genes from this population is then mediated by nuclease-base removal of non-hybridizing fragment ends, polymerization to fill gaps between such fragments and subsequent single stranded ligation. The parental polynucleotide strand can be removed by digestion (e.g., if RNA or uracil-containing), magnetic separation under denaturing conditions (if labeled in a manner conducive to such separation) and other available separation/purification methods. Alternatively, the parental strand is optionally co-purified with the chimeric strands and removed during subsequent screening and processing steps. Additional details regarding this approach are found, e.g., in PCT/US01/06775.

In another approach, single-stranded molecules are converted to double-stranded DNA (dsDNA) and the dsDNA molecules are bound to a solid support by ligand-mediated binding. After separation of unbound DNA, the selected DNA molecules are released from the support and introduced into a suitable host cell to generate a library enriched sequences which hybridize to the probe. A library produced in this manner provides a desirable substrate for further diversification using any of the procedures described herein.

Any of the preceding general recombination formats can be practiced in a reiterative fashion (e.g., one or more cycles of mutation/recombination or other diversity generation methods, optionally followed by one or more selection methods) to generate a more diverse set of recombinant nucleic acids.

Mutagenesis employing polynucleotide chain termination methods have also been proposed (see e.g., U.S. Pat. No. 5,965,408 and the references above), and can be applied to the present invention. In this approach, double stranded DNAs corresponding to one or more genes sharing regions of sequence similarity are combined and denatured, in the presence or absence of primers specific for the gene. The single stranded polynucleotides are then annealed and incubated in the presence of a polymerase and a chain terminating reagent (e.g., ultraviolet, gamma or X-ray irradiation; ethidium bromide or other intercalators; DNA binding proteins, such as single strand binding proteins, transcription activating factors, or histones; polycyclic aromatic hydrocarbons; trivalent chromium or a trivalent chromium salt; or abbreviated polymerization mediated by rapid thermocycling; and the like), resulting in the production of partial duplex molecules. The partial duplex molecules, e.g., containing partially extended chains, are then denatured and reannealed in subsequent rounds of replication or partial replication resulting in polynucleotides which share varying degrees of sequence similarity and which are diversified with respect to the starting population of DNA molecules. Optionally, the products, or partial pools of the products, can be amplified at one or more stages in the process. Polynucleotides produced by a chain termination method, such as described above, are suitable substrates for any other described recombination format.

Diversity also can be generated in nucleic acids or populations of nucleic acids using a recombinational procedure termed "incremental truncation for the creation of hybrid enzymes" ("ITCHY") described in Ostermeier et al. (1999) *Nature Biotech* 17:1205. This approach can be used to generate an initial a library of variants which can optionally serve as a substrate for one or more in vitro or in vivo recombination methods. See, also, Ostermeier et al. (1999) *Proc. Natl. Acad. Sci. USA*, 96: 3562-67; Ostermeier et al. (1999), *Biological and Medicinal Chemistry* 7: 2139-44.

Mutational methods which result in the alteration of individual nucleotides or groups of contiguous or non-contiguous nucleotides can be favorably employed to introduce nucleotide diversity into the nucleic acid sequences and/or gene fusion constructs of the present invention. Many mutagenesis methods are found in the above-cited references; additional details regarding mutagenesis methods can be found in following, which can also be applied to the present invention.

For example, error-prone PCR can be used to generate nucleic acid variants. Using this technique, PCR is performed under conditions where the copying fidelity of the DNA polymerase is low, such that a high rate of point mutations is obtained along the entire length of the PCR product. Examples of such techniques are found in the references above and, e.g., in Leung et al. (1989) *Technique* 1:11-15 and Caldwell et al. (1992) *PCR Methods Applic.* 2:28-33. Similarly, assembly PCR can be used, in a process which involves the assembly of a PCR product from a mixture of small DNA fragments. A large number of different PCR reactions can occur in parallel in the same reaction mixture, with the products of one reaction priming the products of another reaction.

Oligonucleotide directed mutagenesis can be used to introduce site-specific mutations in a nucleic acid sequence of interest. Examples of such techniques are found in the references above and, e.g., in Reidhaar-Olson et al. (1988) *Science* 241:53-57. Similarly, cassette mutagenesis can be used in a process that replaces a small region of a double stranded DNA molecule with a synthetic oligonucleotide cassette that differs from the native sequence. The oligonucleotide can contain, e.g., completely and/or partially randomized native sequence(s).

Recursive ensemble mutagenesis is a process in which an algorithm for protein mutagenesis is used to produce diverse populations of phenotypically related mutants, members of which differ in amino acid sequence. This method uses a feedback mechanism to monitor successive rounds of combinatorial cassette mutagenesis. Examples of this approach are found in Arkin & Youvan (1992) *Proc. Natl. Acad. Sci. USA* 89:7811-7815.

Exponential ensemble mutagenesis can be used for generating combinatorial libraries with a high percentage of unique and functional mutants. Small groups of residues in a sequence of interest are randomized in parallel to identify, at each altered position, amino acids which lead to functional proteins. Examples of such procedures are found in Delegrave & Youvan (1993) *Biotechnology Research* 11:1548-1552.

In vivo mutagenesis can be used to generate random mutations in any cloned DNA of interest by propagating the DNA, e.g., in a strain of *E. coli* that carries mutations in one or more of the DNA repair pathways. These "mutator" strains have a higher random mutation rate than that of a wild-type parent. Propagating the DNA in one of these strains will eventually generate random mutations within the DNA. Such procedures are described in the references noted above.

Other procedures for introducing diversity into a genome, e.g. a bacterial, fungal, animal or plant genome can be used in conjunction with the above described and/or referenced methods. For example, in addition to the methods above, techniques have been proposed which produce nucleic acid multimers suitable for transformation into a variety of species (see, e.g., U.S. Pat. No. 5,756,316 and the references above). Transformation of a suitable host with such multimers, consisting of genes that are divergent with respect to one another, (e.g., derived from natural diversity or through application of site directed mutagenesis, error prone PCR, passage through mutagenic bacterial strains, and the like), provides a source of nucleic acid diversity for DNA diversification, e.g., by an in vivo recombination process as indicated above.

Alternatively, a multiplicity of monomeric polynucleotides sharing regions of partial sequence similarity can be transformed into a host species and recombined in vivo by the host cell. Subsequent rounds of cell division can be used to generate libraries, members of which, include a single, homogenous population, or pool of monomeric polynucleotides. Alternatively, the monomeric nucleic acid can be recovered by standard techniques, e.g., PCR and/or cloning, and recombined in any of the recombination formats, including recursive recombination formats, described above.

Methods for generating multispecies expression libraries have been described (in addition to the reference noted above, see, e.g., U.S. Pat. No. 5,783,431 and U.S. Pat. No. 5,824,485) and their use to identify protein activities of interest has been proposed (In addition to the references noted above, see, U.S. Pat. No. 5,958,672. Multispecies expression libraries include, in general, libraries comprising cDNA or genomic sequences from a plurality of species or strains, operably linked to appropriate regulatory sequences, in an expression cassette. The cDNA and/or genomic sequences are optionally randomly ligated to further enhance diversity. The vector can be a shuttle vector suitable for transformation and expression in more than one species of host organism, e.g., bacterial species, eukaryotic cells. In some cases, the library is biased by preselecting sequences which encode a protein of interest, or which hybridize to a nucleic acid of interest. Any such libraries can be provided as substrates for any of the methods herein described.

The above described procedures have been largely directed to increasing nucleic acid and/or encoded protein diversity. However, in many cases, not all of the diversity is useful, e.g., functional, and contributes merely to increasing the background of variants that must be screened or selected to identify the few favorable variants. In some applications, it is desirable to preselect or prescreen libraries (e.g., an amplified library, a genomic library, a cDNA library, a normalized library, etc.) or other substrate nucleic acids prior to diversification, e.g., by recombination-based mutagenesis procedures, or to otherwise bias the substrates towards nucleic acids that encode functional products. For example, in the case of antibody engineering, it is possible to bias the diversity generating process toward antibodies with functional antigen binding sites by taking advantage of in vivo recombination events prior to manipulation by any of the described methods. For example, recombined CDRs derived from B cell cDNA libraries can be amplified and assembled into framework regions (e.g., Jirholt et al. (1998) *Gene* 215: 471) prior to diversifying according to any of the methods described herein.

Libraries can be biased towards nucleic acids which encode proteins with desirable enzyme activities. For example, after identifying a variant from a library which exhibits a specified activity, the variant can be mutagenized using any known method for introducing DNA alterations. A library comprising the mutagenized homologues is then screened for a desired activity, which can be the same as or different from the initially specified activity. An example of such a procedure is proposed in U.S. Pat. No. 5,939,250. Desired activities can be identified by any method known in the art. For example, WO 99/10539 proposes that gene libraries can be screened by combining extracts from the gene library with components obtained from metabolically rich cells and identifying combinations which exhibit the desired activity. It has also been proposed (e.g., WO 98/58085) that clones with desired activities can be identified by inserting bioactive substrates into samples of the library, and detecting bioactive fluorescence corresponding to the product of a desired activity using a fluorescent analyzer, e.g., a flow cytometry device, a CCD, a fluorometer, or a spectrophotometer.

Libraries can also be biased towards nucleic acids which have specified characteristics, e.g., hybridization to a selected nucleic acid probe. For example, application WO 99/10539 proposes that polynucleotides encoding a desired activity (e.g., an enzymatic activity, for example: a lipase, an esterase, a protease, a glycosidase, a glycosyl transferase, a phosphatase, a kinase, an oxygenase, a peroxidase, a hydrolase, a hydratase, a nitrilase, a transaminase, an amidase or an acylase) can be identified from among genomic DNA sequences in the following manner. Single stranded DNA molecules from a population of genomic DNA are hybridized to a ligand-conjugated probe. The genomic DNA can be derived from either a cultivated or uncultivated microorganism, or from an environmental sample. Alternatively, the genomic DNA can be derived from a multicellular organism, or a tissue derived there from. Second strand synthesis can be conducted directly from the hybridization probe used in the capture, with or without prior release from the capture medium or by a wide variety of other strategies known in the art. Alternatively, the isolated single-stranded genomic DNA population can be fragmented without further cloning and used directly in, e.g., a recombination-based approach, that employs a single-stranded template, as described above.

"Non-Stochastic" methods of generating nucleic acids and polypeptides are found in WO 00/46344. These methods, including proposed non-stochastic polynucleotide reassembly and site-saturation mutagenesis methods be applied to the present invention as well. Random or semi-random mutagenesis using doped or degenerate oligonucleotides is also described in, e.g., Arkin and Youvan (1992) *Biotechnology* 10:297-300; Reidhaar-Olson et al. (1991) *Methods Enzymol.* 208:564-86; Lim and Sauer (1991) *J. Mol. Biol.* 219:359-76; Breyer and Sauer (1989) *J. Biol. Chem.* 264:13355-60); and U.S. Pat. Nos. 5,830,650 and 5,798,208, and EP Patent 0527809 B1.

It will readily be appreciated that any of the above described techniques suitable for enriching a library prior to diversification can also be used to screen the products, or libraries of products, produced by the diversity generating methods. Any of the above described methods can be practiced recursively or in combination to alter nucleic acids, e.g., HPPD encoding polynucleotides.

The above references provide many mutational formats, including recombination, recursive recombination, recursive mutation and combinations or recombination with other forms of mutagenesis, as well as many modifications of these formats. Regardless of the diversity generation format that is used, the nucleic acids of the present invention can be recombined (with each other, or with related (or even unrelated) sequences) to produce a diverse set of recombinant nucleic acids for use in the gene fusion constructs and modified gene fusion constructs of the present invention, including, e.g., sets of homologous nucleic acids, as well as corresponding polypeptides.

Many of the above-described methodologies for generating modified polynucleotides generate a large number of diverse variants of a parental sequence or sequences. In some embodiments, the modification technique (e.g., some form of shuffling) is used to generate a library of variants that is then screened for a modified polynucleotide or pool of modified polynucleotides encoding some desired functional attribute, e.g., improved HPPD inhibitor insensitivity and/or maintained or improved HPPD activity.

One example of selection for a desired enzymatic activity entails growing host cells under conditions that inhibit the growth and/or survival of cells that do not sufficiently express an enzymatic activity of interest, e.g. the HPPD activity. Using such a selection process can eliminate from consideration all modified polynucleotides except those encoding a desired enzymatic activity. For example, in some embodiments of the invention host cells are maintained under conditions that inhibit cell growth or survival in the absence of sufficient levels of HPPD, e.g., a concentration of an HPPD inhibitor that is lethal or inhibits the growth of a wild-type plant of the same variety that lacks or does not express the HPPD polynucleotide or active variant or fragment thereof. Under these conditions, only a host cell harboring a modified nucleic acid that encodes enzymatic activity or activities able to catalyze production of sufficient levels of the product will survive and grow. Some embodiments of the invention employ multiples rounds of screening at increasing concentrations of an HPPD inhibitor.

For convenience and high throughput it will often be desirable to screen/select for desired modified nucleic acids in a microorganism, e.g., a bacteria such as *E. coli*. On the other hand, screening in plant cells or plants can in some cases be preferable where the ultimate aim is to generate a modified nucleic acid for expression in a plant system.

In some preferred embodiments of the invention throughput is increased by screening pools of host cells expressing different modified nucleic acids, either alone or as part of a gene fusion construct. Any pools showing significant activity can be deconvoluted to identify single variants expressing the desirable activity.

In high throughput assays, it is possible to screen up to several thousand different variants in a single day. For example, each well of a microtiter plate can be used to run a separate assay, or, if concentration or incubation time effects are to be observed, every 5-10 wells can test a single variant.

In addition to fluidic approaches, it is possible, as mentioned above, simply to grow cells on media plates that select for the desired enzymatic or metabolic function. This approach offers a simple and high-throughput screening method.

A number of well known robotic systems have also been developed for solution phase chemistries useful in assay systems. These systems include automated workstations like the automated synthesis apparatus developed by Takeda Chemical Industries, LTD. (Osaka, Japan) and many robotic systems utilizing robotic arms (Zymate II, Zymark Corporation, Hopkinton, Mass.; Orca, Hewlett-Packard, Palo Alto, Calif.) which mimic the manual synthetic operations performed by a scientist. Any of the above devices are suitable for application to the present invention. The nature and implementation of modifications to these devices (if any) so that they can operate as discussed herein with reference to the integrated system will be apparent to persons skilled in the relevant art.

High throughput screening systems are commercially available (see, e.g., Zymark Corp., Hopkinton, Mass.; Air Technical Industries, Mentor, Ohio; Beckman Instruments, Inc. Fullerton, Calif.; Precision Systems, Inc., Natick, Mass., etc.). These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization.

The manufacturers of such systems provide detailed protocols for the various high throughput devices. Thus, for example, Zymark Corp. provides technical bulletins describing screening systems for detecting the modulation of gene transcription, ligand binding, and the like. Microfluidic approaches to reagent manipulation have also been developed, e.g., by Caliper Technologies (Mountain View, Calif.). Non-limiting embodiments include:

1. An isolated or recombinant polynucleotide comprising a nucleotide sequence encoding an HPPD polypeptide, wherein said polynucleotide encodes a polypeptide comprising:
   a. an amino acid sequence having at least 60%, 70%, 80% or 90% sequence identity across the full length of any one of SEQ ID NOS: 1, 2, 328, 329, 330, 331, 332, 333, 334, 335, 336, 337, 338, 339, 340, 327, 391, 392, 394, or 396; and, having at least one of the amino acid sequences set forth in SEQ ID NO:377, 372, 373, 374, 375, 376, 378, 379, 380, 381, 382, 460, 461, 462, 463, 467, 468, 469-488, or 489, wherein said polypeptide has 4-hydroxyphenylpyruvate dioxygenase (HPPD) activity and displays insensitivity to an HPPD inhibitor; or
   b. an HPPD polypeptide comprising the amino acid sequence set forth in SEQ ID NO:377, 372, 373, 374, 375, 376, 378, 379, 380, 381, 382, 460, 461, 462 or 463, wherein said polypeptide has HPPD activity and displays insensitivity to an HPPD inhibitor.

2. An isolated or recombinant polynucleotide comprising a nucleotide sequence encoding a polypeptide, wherein said polypeptide has 4-hydroxyphenylpyruvate dioxygenase (HPPD) activity and has insensitivity to at least one HPPD inhibitor and comprises an amino acid sequence having:
   (a) a similarity score of at least 1853 with SEQ ID NO:109;
   (b) a similarity score of at least 1855 with SEQ ID NO:101;
   (c) a similarity score of at least 1862 with SEQ ID NO:50;
   (d) a similarity score of at least 1864 with SEQ ID NO:56 or SEQ ID NO: 164;
   (e) a similarity score of at least 2267 with SEQ ID NO:103;
   (f) a similarity score of at least 2268 with SEQ ID NO:160;
   (g) a similarity score of at least 1855 with SEQ ID NO: 412;
   wherein said similarity score is generated using the BLAST alignment program, with the BLOSUM62 substitution matrix, a gap existence penalty of 11, and a gap extension penalty of 1.

3. An isolated or recombinant polynucleotide comprising a nucleotide sequence encoding a polypeptide, wherein said polypeptide has 4-hydroxyphenylpyruvate dioxygenase (HPPD) activity and has insensitivity to at least one HPPD inhibitor and comprises an amino acid sequence having:
   (a) a similarity score of at least 1830 with SEQ ID NO:263;
   (b) a similarity score of at least 1839 with SEQ ID NO:212;
   (c) a similarity score of at least 1840 with SEQ ID NO:218;
   (d) a similarity score of at least 2152 with SEQ ID NO:320;
   (e) a similarity score of at least 2176 with SEQ ID NO:275;
   (f) a similarity score of at least 2177 with SEQ ID NO:265; or,
   (j) a similarity score of at least 1825 with SEQ ID NO: 433;

wherein said similarity score is generated using the BLAST alignment program, with the BLOSUM62 substitution matrix, a gap existence penalty of 11, and a gap extension penalty of 1.

4. An isolated or recombinant polynucleotide comprising a nucleotide sequence encoding an HPPD polypeptide, wherein said polynucleotide encodes an amino acid sequence having at least 60% sequence identity to any one of SEQ ID NOS: 1, 2, 328, 329, 330, 331, 332, 333, 334, 335, 336, 337, 338, 339, 340, 327, 391, 392, 394, or 396, wherein said polypeptide has HPPD activity and displays insensitivity to an HPPD inhibitor, wherein
 a) the amino acid residue in the encoded polypeptide that corresponds to amino acid position 414 of SEQ ID NO:1 comprises a lysine, arginine, histidine, or alanine;
 b) the amino acid residue in the encoded polypeptide that corresponds to amino acid position 341 of SEQ ID NO:1 comprises a cysteine;
 c) the amino acid residue in the encoded polypeptide that corresponds to amino acid position 341 of SEQ ID NO:1 comprises a cysteine and the encoded polypeptide comprises at least one of the following amino acid residues: the amino acid residue corresponding to amino acid position 261 of SEQ ID NO:1 comprises an alanine, the amino acid residue corresponding to amino acid position 301 of SEQ ID NO:1 comprises an isoleucine, the amino acid residue corresponding to amino acid position 327 of SEQ ID NO:1 comprises a leucine, the amino acid residue corresponding to amino acid position 328 of SEQ ID NO:1 comprises a proline, the amino acid residue corresponding to amino acid position 360 of SEQ ID NO:1 comprises a methionine, and/or the amino acid residue corresponding to amino acid position 417 of SEQ ID NO:1 comprises a glycine.
 d) the amino acid residue in the encoded polypeptide that corresponds to amino acid position 341 of SEQ ID NO:1 comprises a glutamic acid and the encoded polypeptide comprises at least one of the following amino acid residues: the amino acid residue corresponding to amino acid position 328 of SEQ ID NO:1 comprises a proline, the amino acid residue corresponding to amino acid position 360 of SEQ ID NO:1 comprises a methionine, and/or the amino acid residue corresponding to amino acid position 417 of SEQ ID NO:1 comprises a glycine;
 e) the amino acid residue in the encoded polypeptide that corresponds to amino acid position 417 of SEQ ID NO:1 comprises a glycine and the polypeptide comprises at least one of the following amino acid residues: the amino acid position corresponding to amino acid 327 of SEQ ID NO:1 comprises a leucine, the amino acid position corresponding to amino acid 331 of SEQ ID NO:1 comprises a proline, and/or the amino acid position corresponding to amino acid 360 of SEQ ID NO:1 comprises a methionine;
 f) the amino acid residue in the encoded polypeptide that corresponds to amino acid position 261 of SEQ ID NO:1 comprises an alanine and/or that corresponds to amino acid position 301 of SEQ ID NO:1 comprises a isoleucine; and the amino acid residue corresponding to amino acid position 328 of SEQ ID NO:1 comprises a proline and the encoded polypeptide comprises at least one of the following amino acid residues: the amino acid residue corresponding to amino acid position 360 of SEQ ID NO:1 comprises a methionine or the amino acid residue corresponding to amino acid position 417 of SEQ ID NO:1 comprises a glycine;
 g) the amino acid residue in the encoded polypeptide that corresponds to amino acid position 261 of SEQ ID NO:1 comprises an alanine and/or amino acid position 327 of SEQ ID NO:1 comprises a leucine; and the amino acid corresponding to amino acid position 331 of SEQ ID NO:1 comprises a proline and the amino acid corresponding to amino acid position 341 of SEQ ID NO:1 comprises a glutamic acid;
 h) the amino acid residue in the encoded polypeptide that corresponds to amino acid position 209 of SEQ ID NO:1 comprises a valine and amino acid position 233 of SEQ ID NO:1 comprises a leucine; and the encoded polypeptide comprises at least one of the following amino acid residues: the amino acid residue corresponding to amino acid position 301 of SEQ ID NO:1 comprises a isoleucine and the amino acid residue corresponding to amino acid position 327 of SEQ ID NO:1 comprises a leucine;
 i) the amino acid residue in the encoded polypeptide that corresponds to amino acid position 327 of SEQ ID NO:1 comprises a leucine and amino acid position 328 of SEQ ID NO:1 comprises a proline; and the polypeptide comprises at least one of the following amino acid residues: the amino acid residue corresponding to amino acid position 233 of SEQ ID NO:1 comprises a leucine and the amino acid residue corresponding to amino acid position 360 of SEQ ID NO:1 comprises a methionine; or,
 j) at least 1, 2, 3, 4, 5 or 6 of any of the following amino acid residues in the encoded polypeptide that corresponds to amino acid position 44 of SEQ ID NO:1 comprises a glutamine, isoleucine, cysteine, serine, glycine or valine; amino acid position 233 of SEQ ID NO:1 comprises a methionine, cysteine, leucine, isoleucine or valine; the amino acid residue corresponding to amino acid position 316 of SEQ ID NO:1 comprises a glutamine, lysine or arginine; the amino acid residue corresponding to amino acid position 331 of SEQ ID NO:1 comprises a leucine, glycine, glutamine or histidine; the amino acid residue corresponding to amino acid position 341 of SEQ ID NO:1 comprises a cysteine, aspartate or alanine, and/or the amino acid residue corresponding to amino acid position 360 of SEQ ID NO:1 comprises a methionine or leucine; or,
 k) at least 1, 2, 3, 4, 5 or 6 of any of the following amino acid residues in the encoded polypeptide that corresponds to amino acid position 44 of SEQ ID NO:1 comprises a histidine, glutamine, isoleucine, cysteine, serine, glycine or valine; amino acid position 233 of SEQ ID NO:1 comprises a phenylalanine, methionine, cysteine, leucine, isoleucine or valine; the amino acid residue corresponding to amino acid position 316 of SEQ ID NO:1 comprises a glutamine, lysine or arginine; the amino acid residue corresponding to amino acid position 331 of SEQ ID NO:1 comprises a threonine, leucine, glycine, glutamine or histidine; the amino acid residue corresponding to amino acid position 341 of SEQ ID NO:1 comprises a arginine, cysteine, aspartate or alanine, and/or the amino acid residue corresponding to amino acid position 360 of SEQ ID NO:1 comprises a methionine, lysine, or leucine.

5. The isolated or recombinant polynucleotide of any one of embodiments 1, 2, 3 or 4, wherein said polypeptide has an improved insensitivity to an HPPD inhibitor when compared to the polypeptide set forth in SEQ ID NO:1 or to a native HPPD polypeptide.

6. The isolated or recombinant polynucleotide of embodiment 5, wherein the improved insensitivity to an HPPD inhibitor comprises:
   a. a slower rate of association of enzyme and inhibitor as quantified by a higher ON rate ratio than the polypeptide set forth in SEQ ID NO:1 or a native HPPD;
   b. a faster rate of dissociation of inhibitor from enzyme as quantified by a higher OFF rate ratio than the polypeptide set forth in SEQ ID NO:1 or a native HPPD; and/or,
   c. both a slower rate of association of inhibitor with enzyme and a faster rate of dissociation of inhibitor from enzyme as quantified by a higher product of ON rate ratio and OFF rate ratio than the polypeptide set forth in SEQ ID NO:1 or a native HPPD.

7. The isolated or recombinant polynucleotide of any one of embodiments 1-6, wherein said polypeptide comprises a chloroplast transit peptide sequence comprising:
   a. a nucleotide sequence encoding the amino acid sequence set forth in SEQ ID NO: 490, 371 or 464;
   b. a nucleotide sequence encoding a polypeptide having at least 90% sequence identity to the amino acid sequence of SEQ ID NO: 490, 371 or 464, where said polypeptide has chloroplast transit peptide activity; or,
   c. a nucleotide sequence encoding a heterologous chloroplast transit peptide sequence.

8. A nucleic acid construct comprising the isolated or recombinant polynucleotide of any one of embodiments 1-7.

9. The nucleic acid construct of embodiment 8, further comprising a promoter operably linked to said polynucleotide.

10. The nucleic acid construct of embodiment 9, wherein said promoter is heterologous with respect to said polynucleotide or said promoter is homologous with respect to said polynucleotide.

11. A cell comprising at least one polynucleotide of any of embodiments 1-7 or the nucleic acid construct of any one of embodiments 8-10, wherein said polynucleotide is heterologous to the cell.

12. The cell of embodiment 11, wherein said cell is a plant cell.

13. The cell of embodiment 12, wherein said polynucleotide or said nucleic acid construct is stably incorporated into the genome of said plant cell.

14. The cell of embodiment 12, wherein said polynucleotide or said nucleic acid construct is stably incorporated into the chloroplast genome of said plant cell.

15. The cell of any one of embodiments 9-14, wherein said plant cell is from a monocot.

16. The cell of embodiment 15, wherein said monocot is maize, wheat, rice, barley, sugarcane, sorghum, or rye.

17. The cell of any one of embodiments 12-14, wherein said plant cell is from a dicot.

18. The cell of embodiment 17, wherein the dicot is soybean, *Brassica*, sunflower, cotton, or alfalfa.

19. A plant comprising a plant cell of any one of embodiments 12-18.

20. A plant explant comprising a plant cell of any one of embodiments 12-18.

21. The plant, the explant or the plant cell of any one of embodiments 12-20, wherein said plant, explant or plant cell exhibits an increased insensitivity to an HPPD herbicide as compared to a plant, explant or plant cell of the same species, strain or cultivar that does not comprise at least one polynucleotide of any one of embodiments 1-7.

22. The plant, the explant, or the plant cell of any one of embodiments 12-21, wherein the plant, the explant or the plant cell further comprises at least one polypeptide imparting tolerance to an additional herbicide.

23. The plant, the explant, or the plant cell of embodiment 22, wherein said at least one polypeptide imparting tolerance to an additional herbicide comprises:
   (a) a sulfonylurea-tolerant acetolactate synthase;
   (b) an imidazolinone-tolerant acetolactate synthase;
   (c) a glyphosate-tolerant 5-enolpyruvylshikimate-3-phosphate synthase;
   (d) a glyphosate-tolerant glyphosate oxido-reductase;
   (e) a glyphosate-N-acetyltransferase;
   (f) a phosphinothricin acetyl transferase;
   (g) a protoporphyrinogen oxidase.
   (h) an auxin enzyme;
   (i) a P450 polypeptide; or,
   (j) an acetyl coenzyme A carboxylase (ACCase).

24. The plant, the explant, or the plant cell of embodiment 22, wherein said at least one polypeptide imparting tolerance to an additional herbicide comprises a high resistance allele of acetolactate synthase (HRA) and/or a glyphosate-N-acetyltransferase polypeptide.

25. The plant, the explant, or the plant cell of any one of embodiments 12-24, wherein the plant, the explant or the plant cell further comprises at least one additional polypeptide imparting tolerance to an HPPD herbicide.

26. The plant, the explant or the plant cell of embodiment 25, wherein said at least one polypeptide comprises a P450 polypeptide or NSF1.

27. A transgenic seed produced by the plant of any one of embodiments 19 or 21-26.

28. An isolated or recombinant polypeptide comprising an amino acid sequence having
   (a) a similarity score of at least 1853 with SEQ ID NO:109;
   (b) a similarity score of at least 1855 with SEQ ID NO:101;
   (c) a similarity score of at least 1862 with SEQ ID NO:50;
   (d) a similarity score of at least 1864 with SEQ ID NO:56 or SEQ ID NO: 164;
   (e) a similarity score of at least 2267 with SEQ ID NO:103;
   (f) a similarity score of at least 2268 with SEQ ID NO:160; or,
   (j) a similarity score of at least 1855 with SEQ ID NO: 412;
   wherein said similarity score is generated using BLAST alignment program, with the BLOSUM62 substitution matrix, a gap existence penalty of 11, and a gap extension penalty of 1 and wherein said polypeptide has 4-hydroxyphenylpyruvate dioxygenase (HPPD) activity and has insensitivity to an HPPD herbicide.

29. An isolated or recombinant polypeptide comprising an amino acid sequence having
   (a) a similarity score of at least 1830 with SEQ ID NO:263;
   (b) a similarity score of at least 1839 with SEQ ID NO:212;
   (c) a similarity score of at least 1840 with SEQ ID NO:218;
   (d) a similarity score of at least 2152 with SEQ ID NO:320;
   (e) a similarity score of at least 2176 with SEQ ID NO:275;
   (f) a similarity score of at least 2177 with SEQ ID NO:265; or,
   (j) a similarity score of at least 1825 with SEQ ID NO: 433;
   wherein said similarity score is generated using BLAST alignment program, with the BLOSUM62 substitution matrix, a gap existence penalty of 11, and a gap extension penalty of 1, and wherein said polypeptide has 4-hydroxyphenylpyruvate dioxygenase (HPPD) activity and has insensitivity to an HPPD herbicide.

30. An isolated or recombinant polypeptide comprising an amino acid sequence having at least 60%, 70%, 80% or 90% sequence identity to any one of SEQ ID NOS: 1, 2, 328, 329, 330, 331, 332, 333, 334, 335, 336, 337, 338, 339, 340, 327, 391, 392, 394 or 396, wherein said polypeptide has HPPD activity and displays insensitivity to an HPPD inhibitor, wherein
  a) the amino acid residue in the polypeptide that corresponds to amino acid position 414 of SEQ ID NO:1 comprises a lysine, arginine, histidine, or alanine;
  b) the amino acid residue in the polypeptide that corresponds to amino acid position 341 of SEQ ID NO:1 comprises a cysteine;
  c) the amino acid residue in the polypeptide that corresponds to amino acid position 341 of SEQ ID NO:1 comprises a cysteine and the encoded polypeptide comprises at least one of the following amino acid residues: the amino acid residue corresponding to amino acid position 261 of SEQ ID NO:1 comprises an alanine, the amino acid residue corresponding to amino acid position 301 of SEQ ID NO:1 comprises an isoleucine, the amino acid residue corresponding to amino acid position 327 of SEQ ID NO:1 comprises a leucine, the amino acid residue corresponding to amino acid position 328 of SEQ ID NO:1 comprises a proline, the amino acid residue corresponding to amino acid position 360 of SEQ ID NO:1 comprises a methionine, and/or the amino acid residue corresponding to amino acid position 417 of SEQ ID NO:1 comprises a glycine.
  d) the amino acid residue in the polypeptide that corresponds to amino acid position 341 of SEQ ID NO:1 comprises a glutamic acid and the encoded polypeptide comprises at least one of the following amino acid residues: the amino acid residue corresponding to amino acid position 328 of SEQ ID NO:1 comprises a proline, the amino acid residue corresponding to amino acid position 360 of SEQ ID NO:1 comprises a methionine, and/or the amino acid residue corresponding to amino acid position 417 of SEQ ID NO:1 comprises a glycine;
  e) the amino acid residue in the polypeptide that corresponds to amino acid position 417 of SEQ ID NO:1 comprises a glycine and the polypeptide comprises at least one of the following amino acid residues: the amino acid position corresponding to amino acid 327 of SEQ ID NO:1 comprises a leucine, the amino acid position corresponding to amino acid 331 of SEQ ID NO:1 comprises a proline, and/or the amino acid position corresponding to amino acid 360 of SEQ ID NO:1 comprises a methionine;
  f) the amino acid residue in the polypeptide that corresponds to amino acid position 261 of SEQ ID NO:1 comprises an alanine and/or that corresponds to amino acid position 301 of SEQ ID NO:1 comprises a lysine; and the amino acid residue corresponding to amino acid position 328 of SEQ ID NO:1 comprises a proline and the encoded polypeptide comprises at least one of the following amino acid residues: the amino acid residue corresponding to amino acid position 360 of SEQ ID NO:1 comprises a methionine or the amino acid residue corresponding to amino acid position 417 of SEQ ID NO:1 comprises a glycine;
  g) the amino acid residue in the polypeptide that corresponds to amino acid position 261 of SEQ ID NO:1 comprises an alanine and/or amino acid position 327 of SEQ ID NO:1 comprises a leucine; and the amino acid corresponding to amino acid position 331 of SEQ ID NO:1 comprises a proline and the amino acid corresponding to amino acid position 341 of SEQ ID NO:1 comprises a glutamic acid;
  h) the amino acid residue in the polypeptide that corresponds to amino acid position 209 of SEQ ID NO:1 comprises a valine and amino acid position 233 of SEQ ID NO:1 comprises a leucine; and the encoded polypeptide comprises at least one of the following amino acid residues: the amino acid residue corresponding to amino acid position 301 of SEQ ID NO:1 comprises a isoleucine and the amino acid residue corresponding to amino acid position 327 of SEQ ID NO:1 comprises a leucine;
  i) the amino acid residue in the polypeptide that corresponds to amino acid position 327 of SEQ ID NO:1 comprises a leucine and amino acid position 328 of SEQ ID NO:1 comprises a proline; and the polypeptide comprises at least one of the following amino acid residues: the amino acid residue corresponding to amino acid position 233 of SEQ ID NO:1 comprises a leucine and the amino acid residue corresponding to amino acid position 360 of SEQ ID NO:1 comprises a methionine; or,
  j) at least 1, 2, 3, 4, 5 or 6 of any of the following amino acid residues in the encoded polypeptide that corresponds to amino acid position 44 of SEQ ID NO:1 comprises a glutamine, isoleucine, cysteine, serine, glycine or valine; amino acid position 233 of SEQ ID NO:1 comprises a methionine, cysteine, leucine, isoleucine or valine; the amino acid residue corresponding to amino acid position 316 of SEQ ID NO:1 comprises a glutamine, lysine or arginine; the amino acid residue corresponding to amino acid position 331 of SEQ ID NO:1 comprises a leucine, glycine, glutamine or histidine; the amino acid residue corresponding to amino acid position 341 of SEQ ID NO:1 comprises a cysteine, aspartate or alanine, or the amino acid residue corresponding to amino acid position 360 of SEQ ID NO:1 comprises a methionine or leucine; or,
  k) at least 1, 2, 3, 4, 5 or 6 of any of the following amino acid residues in the encoded polypeptide that corresponds to amino acid position 44 of SEQ ID NO:1 comprises a histidine, glutamine, isoleucine, cysteine, serine, glycine or valine; amino acid position 233 of SEQ ID NO:1 comprises a phenylalanine, methionine, cysteine, leucine, isoleucine or valine; the amino acid residue corresponding to amino acid position 316 of SEQ ID NO:1 comprises a glutamine, lysine or arginine; the amino acid residue corresponding to amino acid position 331 of SEQ ID NO:1 comprises a threonine, leucine, glycine, glutamine or histidine; the amino acid residue corresponding to amino acid position 341 of SEQ ID NO:1 comprises a arginine, cysteine, aspartate or alanine, or the amino acid residue corresponding to amino acid position 360 of SEQ ID NO:1 comprises a methionine, lysine, or leucine.

31. An isolated or recombinant polypeptide comprising
  a. an amino acid sequence having at least 60%, 70%, 80% or 90% sequence identity across the full length of any one of SEQ ID NOS: 1, 2, 328, 329, 330, 331, 332, 333, 334, 335, 336, 337, 338, 339, 340, 327, 391, 392, 394, 396, 460, 461, 462, or 463; and,
  b. having at least one of the amino acid sequences set forth in SEQ ID NO:372, 373, 374, 375, 376, 377, 378, 379, 380, 381, or 382, wherein said polypeptide has 4-hydroxyphenylpyruvate dioxygenase (HPPD) activity and displays insensitivity to an HPPD inhibitor.

32. The isolated or recombinant polypeptide of any one of embodiments 28-31, wherein said polypeptide has an increased insensitivity to an HPPD herbicide when compared to the polypeptide set forth in SEQ ID NO:1 or to a native HPPD polypeptide.

33. The isolated or recombinant polypeptide of embodiment 32, wherein the improved insensitivity to an HPPD inhibitor comprises:
   a. a slower rate of association of enzyme and inhibitor as quantified by a higher ON rate ratio than the polypeptide set forth in SEQ ID NO:1 or the native HPPD;
   b. a faster rate of dissociation of inhibitor from enzyme as quantified by a higher OFF rate ratio than the polypeptide set forth in SEQ ID NO:1 or a native HPPD; and/or,
   c. both a slower rate of association of inhibitor with enzyme and a faster rate of dissociation of inhibitor from enzyme as quantified by a higher product of ON rate ratio and OFF rate ratio than the polypeptide set forth in SEQ ID NO:1 or a native HPPD.

34. The isolated or recombinant polypeptide of any one of embodiments 28-33, wherein said polypeptide comprises a chloroplast transit peptide sequence comprising:
   a. the amino acid sequence set forth in SEQ ID NO: 490, 371 or 464;
   b. a nucleotide sequence encoding a polypeptide having at least 90% sequence identity to the amino acid sequence of SEQ ID NO: 490, 371 or 464, wherein said polypeptide has chloroplast transit peptide activity; or,
   c. an amino acid sequence comprising a heterologous chloroplast transit peptide sequence.

35. A method of producing a 4-hydroxyphenylpyruvate dioxygenase (HPPD) herbicide tolerant plant cell comprising transforming a plant cell with the polynucleotide of any one of embodiments 1-7 or the nucleic acid construct of any one of embodiments 8, 9, 10 or 11.

36. The method of embodiment 35, further comprising selecting a plant cell which is resistant to an HPPD herbicide by growing plant cells in the presence of a concentration of an HPPD herbicide that bleaches said plant cell which does not comprise a polynucleotide of any one of embodiments 1-7 or the nucleic acid construct of any one of embodiments 8, 9, 10 or 11.

37. The method of embodiment 36, wherein said method comprises
   (a) culturing said plant cell in the presence of a sufficient concentration of an HPPD herbicide such that said plant cells display bleaching;
   (b) transforming into said plant cells of step (a) the polynucleotide of any one of embodiments 1-7 or the nucleic acid construct of any one of embodiments 8, 9, 10 or 11;
   (c) growing said plant cells of (b), wherein transformed plants cells no longer display bleaching.

38. The method of embodiment 35, 36, or 37, wherein said method further comprises regenerating a transgenic plant from said plant cell.

39. The method of any one of embodiments 35-38, wherein said transforming the plant cell results in the stable integration of the polynucleotide into the genome of the plant cell.

40. The method of any one of embodiments 35-38, wherein said transforming the plant cell results in the stable integration of the polynucleotide into the genome of a chloroplast in said plant cell.

41. A method for controlling weeds in a field containing a crop comprising:
   (a) planting the field with the transgenic seeds of embodiment 27 or the plant of any one of embodiments 19 or 21-26; and,
   (b) applying to any crop and weeds in the field a sufficient amount of an HPPD herbicide to control weeds without significantly affecting the crop.

42. The method of any one of embodiments 36, 37 or 41, wherein said HPPD herbicide comprises at least one of triketones, isoxazoles, pyrazoles, or benzobicyclon or active derivatives thereof or an agriculturally acceptable salt thereof.

43. The method of embodiment 42, wherein said HPPD herbicide comprises at least one of mesotrione, sulcotrione, topremezone, and tembotrione, pyrasulfotole, isoxaflutole, benzofenap, pyrazoxyfen, or pyrazolynate or active derivative thereof or an agriculturally acceptable salt thereof 44. The method of embodiment 41 further comprising applying to the crop and weeds in the field a sufficient amount of at least one additional herbicide comprising glyphosate, bialaphos, phosphinothricin, azafenidin, butafenacil, sulfosate, glufosinate, an ALS inhibitor, or a protox inhibitor.

45. A method for detecting an HPPD polypeptide comprising analyzing plant tissues using an immunoassay comprising an antibody or antibodies that specifically recognizes a polypeptide of any one of embodiments 28-34, wherein said antibody or antibodies are raised to a polypeptide of any one of embodiments 28-34 as an antigen.

46. A method for detecting the presence of a polynucleotide of any one of embodiments 1-7 comprising assaying plant tissue using PCR amplification and detecting said polynucleotide.

EXPERIMENTAL

4-Hydroxyphenylpyruvate dioxygenase (HPPD) is a non-heme iron-dependent oxygenase that catalyzes the conversion of 4-hydroxyphenylpyruvate to homogentisate (Moran (2005) *Arch Biochem Biophys* 433:117-128). In organisms that degrade tyrosine, the reaction catalyzed by HPPD is the second step in the pathway. In plants, formation of homogentisate is necessary for the synthesis of plastoquinone, an essential redox cofactor, and tocopherol (DellaPenna (2006) *Ann Rev Plant Biol* 57: 711-738). Certain naturally occurring polyketones are allelopathic due to their ability to inhibit HPPD, preventing the production of homogentisate and therefore of plastoquinone. One of these compounds, leptospermone, produced by the plant species *Callistemon citrinus*, was a lead compound in the discovery of the commercial herbicide mesotrione (Mitchell G et al. (2001) *Pest Manag Sci* 57:120-128). DNA shuffling has been used to alter the properties of various enzymes to make them more suitable for commercial application (Castle et al., (2004) Science, 304, 1151-1154). In the present invention, maize HPPD is altered through DNA shuffling to render it less sensitive to inhibition by herbicidal inhibitors. In terms of a chemical constant familiar to those skilled in the art, the goal was to elevate the $K_D$ for inhibitors such as mesotrione while preserving the catalytic parameters near those of wild-type maize HPPD. Higher $K_D$ means that in the presence of a herbicidal inhibitor, a larger fraction of the enzyme will be free to react with substrate, thereby sustaining flux through the biosynthetic pathway to plastoquinone.

Example 1

Characterization of Wild-Type Maize (SEQ ID NO: 1) and Soy (SEQ ID NO: 2) HPPD Proteins HPPD Expression and Purification A synthetic maize wild-type HPPD gene (referred to herein as the maize wild-type sequence) was assembled from commercially synthesized oligonucleotides to deliver the amino acid sequence of SEQ ID NO: 1. During the synthesis of the gene, an NcoI restriction site was engineered into the start of the sequence to facilitate cloning. The change of codons (C)ATG CCC to (C)ATG GGT resulted in the substitution of *Glycine* for Proline at position 2 in SEQ ID NO: 1 compared to the maize wild-type protein of WO1997049816 SEQ ID NO: 11, which is herein numbered as SEQ ID NO: 392.

Wild type and shuffled variant genes were cloned into pVER7062, a modified version of pET24a(+)(Novagen), which places six histidine residues at the N-terminus of the expressed protein. Vectors were electroporated into *E. coli* host strain BL21(DE3). Cells were grown at 30 C in rich medium such as 2xYT containing the selection antibiotic, kanamycin. At a density of about 0.6 OD600, IPTG was added to 0.2 mM. After further growth for 60 min at 30 C, the temperature was reduced to 16 C and growth continued for another 24 hrs. Cells were harvested by centrifugation and stored at −80 C. Cell pellets were lysed in BPER (Pierce) protein extraction reagent containing 0.2 mg/ml lysozyme, 1 mM dithiothreitol, protease inhibitor cocktail (Sigma, bacterial cocktail) and endonuclease. Insoluble cellular debris was removed by centrifugation. HPPD protein was purified from the soluble protein solution by affinity chromatography on the nickel form of nitrilotriacetic acid (Ni-NTA) resin (Qiagen). Protein concentrations were determined by the Bradford method, as supplied by Bio-Rad.

HPPD Assay

HPPD catalyzes the conversion of 4-hydroxyphenylpyruvate (HPP) to homogentisate. See, FIG. 1. Substrate and product do not differ in absorbance of light at any useful wavelength. However, the product of the ensuing reaction in tyrosine metabolism, maleylacetoacetate, absorbs strongly at 320 nm. Furthermore, the enzyme catalyzing that reaction is also a dioxygenase having similar mechanism and buffer requirements as HPPD, making homogentisate dioxygenase (HGD) an ideal partner in a coupled assay, as shown.

The HDG gene from *Pseudomonas aeruginosa* (Amaya (2004) *Arch Biochem Biophys* 421, 135-142) was cloned into pVER7062 and electroporated into *E. coli* strain BL21(DE3). The enzyme was produced by methods similar to those described for HPPD. The purified enzyme has a $K_M$ for homogentisate of 23 uM and a $k_{cat}$ of 100/sec, properties highly suited for instantly converting the homogentisate produced by HPPD to maleylacetoacetate.

HPPD activity was measured by placing an aliquot (e.g., 6 ul) of the substrate HPP at 50-fold the desired final concentration into the wells of a low UV-absorbing assay plate. Reactions were started by adding a mixture (e.g., 294 ul) containing 25 mM Hepes, pH 7, 2 mM ascorbate, 10 uM FeSO4, 1 to 100 uM HPP, 50 nM HGD and 5 to 240 nM HPPD. Absorbance at 320 nm was monitored continuously in a plate-reading spectrophotometer (Spectramax, Molecular Devices).

HPPD Activity Parameters

The catalytic performance of wild-type HPPD and variants generated by shuffling was assessed by determining the substrate saturation parameters. The Michaelis-Menten kinetics protocol of the Spectramax software was customized for HPP concentrations ranging from 3.33 uM to 100 uM, or up to 1 mM if required. Reaction rates were measured as described above for each concentration of HPP. The software returns values of $K_M$ and Vmax using the Lineweaver-Burke transformation of the Michaelis-Menten equation. Values obtained for the *E. coli*-expressed wild-type HPPD from maize and soybean are shown in Table 2.

TABLE 2

Kinetic parameters of wild-type HPPD from maize and soybean

| HPPD | $K_M$, uM | $k_{cat}$, min$^{-1}$ | $k_{cat}/K_M$ |
|---|---|---|---|
| Maize wt | 5.2 | 207 | 39.8 |
| Soy wt | 3.00 | 100 | 33.3 |

HPPD Inhibitor Sensitivity Parameters

All herbicidal inhibitors of HPPD form a tight complex with the enzyme by the dual mechanisms of coordination to the active site iron atom through a pair of keto oxygens and a Pi stack of the aromatic ring of the inhibitor between a pair of active site phenylalanines. As a result, conventional $I_{50}$ determinations are not able to distinguish differences in binding affinity among various forms of HPPD and the inhibitor. All values will similarly approximate 50% of the enzyme concentration. To devise a parameter for detecting changes in inhibitor binding affinity, $K_D$, one can utilize the relationship between $K_D$ and the rates of binding and release of inhibitor to and from the enzyme.

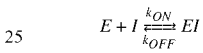

At equilibrium, rates of binding and release are equal. Thus, $$k_{ON}[E][I] = k_{OFF}[EI]$$

Written as a dissociation, the equation can be re-arranged to:

$$\frac{[E][I]}{[EI]} = \frac{k_{OFF}}{k_{ON}} = K_D$$

Higher $K_D$ (reduced affinity or increased insensitivity) can be attained with a numerically smaller ON rate, a larger OFF rate or both. To detect changes in ON and OFF rates, one can observe the time course of an HPPD reaction as inhibitor binds to and inactivates the enzyme (ON rate), or is released from a pre-formed enzyme-inhibitor complex (OFF rate). In practice, a quantitative indicator of ON rate was obtained by monitoring the time courses of HPPD reactions containing 60 or 120 nM HPPD and 100 uM HPP in the presence and absence of 4 uM inhibitor (e.g. mesotrione). The ratio of the reaction rate with inhibitor to that without inhibitor during the 70 to 90 second interval of the reaction was termed the "ON rate ratio". The smaller the actual $k_{ON}$, the more slowly the HPPD reaction decelerates and the higher the value is for the ON rate ratio. FIG. 2 illustrates the contrasting reaction velocity in the 70-90 sec interval for maize wild-type HPPD (FIG. 2A) versus an improved variant (D0223944) (FIG. 2B).

A quantitative indicator of OFF rate can be obtained by observing the time course of an HPPD reaction as mesotrione is released from a pre-formed enzyme-inhibitor complex. HPPD and mesotrione were incubated together at concentrations of 7.2 and 8 uM, respectively. Incubations with the same concentrations of enzyme but no mesotrione were done in parallel. After 1 hr at room temperature, 5 to 10 ul of the enzyme-inhibitor complex was dispensed into the wells of the assay plate. Reactions were started with the addition of 290 to 295 ul of 25 mM Hepes, pH 7, 2 mM ascorbate, 10 uM FeSO$_4$, 100 uM HPP and 50 nM HGD. The reactions were monitored at 320 nm for 12 min. Reaction velocity accelerates as inhibitor is released from the enzyme until a steady state is reached, during which the reaction velocity is constant. The ratio of the steady state rate in mixtures containing mesotrione (or other herbicidal inhibitor) to the initial velocity of mixtures lacking inhibitor is termed the "OFF rate ratio". Another parameter to record is the time span required for the reactions with inhibitor to reach the steady state. FIG. 3 illustrates the contrasting time span in which maize wild-type HPPD (FIG. 3A) and an improved variant (D0223944) (FIG. 3B) dissociated from mesotrione, as indicated by the accelerating reaction rates.

The plateau of absorbance is due to exhaustion of the substrate. With the improved variant, not only was the steady state attained in a shorter time span (80 sec for the variant versus 280 sec for wild type), the velocity attained was twice as high as with wild type, though the enzymes were present at the same concentration (240 nM). This is because a larger fraction of the variant enzyme is free of inhibitor compared to the wild-type enzyme, and the $k_{cat}$ for both is nearly the same, about 220 min$^{-1}$.

It is not certain that the steady state attained in the OFF rate reactions actually represents an equilibrium where OFF rates are now equal to ON rates. Because substrate and inhibitors bind in the same site, the high concentration of substrate present may competitively trap the inhibitor and prevent it from binding again. To be sure that improvement in ON rates is being taken into account, the ON and OFF rate ratios were multiplied together and the product is termed the "insensitivity parameter".

Example 2

DNA Shuffling Based on Phylogenetic Diversity to Create Maize HPPD Variants with Improved Insensitivity Parameter Gene shuffling is an iterative process consisting of discrete cycles termed "rounds". Each iteration is a cycle of parent selection, library construction, gene evaluation and hit selection. The best hits from one round become the parental genes for the next round.

The first phase of HPPD optimization was designed to introduce amino acid substitutions as found in naturally occurring HPPD proteins. Shuffled gene variant libraries were made based on the maize HPPD protein template (SEQ ID NO: 1) using techniques including family shuffling, single-gene shuffling, back-crossing, semi-synthetic and synthetic shuffling (Zhang J-H et al. (1997) *Proc Natl Acad Sci* 94, 4504-4509; Crameri et al. (1998) *Nature* 391: 288-291; Ness et al. (2002) *Nat Biotech* 20:1251-1255). Libraries were based on phylogenetic sequence diversity, random mutagenesis, and structural features based on crystal structures of proteins in Protein Data Bank (PDB; pdb.org/pdb/home/home.do). Phylogenetic diversity of several monocot HPPD proteins is shown in FIG. 4, dicot diversity compared to the maize HPPD is shown in FIG. 5. Diversity is defined as the amino acids present within the set of proteins at any position where all proteins do not contain the identical amino acid. The shuffling process resulted in generation of variants with recombinations of amino acid substitutions, unintended amino acid substitutions due to mutagenic per, deletions, and insertions.

Example 3

Shuffling HPPD Based on Tertiary Structural Models

Structural coordinates of several HPPD enzymes ligated with various inhibitors are deposited in the Protein Data Bank, and were used for selecting positions in which to incorporate natural diversity. More precise designs targeting amino acids that interact directly with a herbicidal inhibitor were enabled by constructing a model of maize HPPD ligated with mesotrione (see below).

Natural Diversity within 12 Å of the Active Site

The active site of HPPD was interrogated by substituting amino acids within 12 Å of the inhibitor DAS645 bound to *Arabidopsis* HPPD in structure 1TG5 (Yang et al., Biochemistry 43, 10414-10423, 2004) with phylogenetic diversity from monocot genes whose sequences were available in public databases. See Table 3.

TABLE 3

Substitutions, 12 Å from active site (amino acid residue position is based on maize wild-type HPPD sequence SEQ ID 1).

| Residue | WT residue | Designed Library |
|---------|------------|------------------|
| 219 | I | V |
| 247 | T | A |
| 253 | A | T |
| 260 | M | V |
| 289 | F | Y |
| 301 | M | I |
| 303 | L | V |
| 327 | M | L |
| 328 | A | P |
| 330 | P | R |
| 331 | T | P, C, L |
| 352 | K | N |
| 377 | V | L |
| 383 | L | F |
| 387 | I | M |
| 418 | Q | E |

Manipulating the β-Sheet

The "beta-back" library focused on the amino acid residues located on the beta-sheet that forms the active site of HPPD, and was limited to those residues whose side chains point away from the active-site. The design target of the "beta-back" library was to reduce inhibitor binding affinity by introducing additional side chain conformations that may result in moving the entire strand into the space that would be occupied by the inhibitor, thus reducing the size of the active site while preserving key active site residues. The substitutions were selected by analysis of the structure of the *Streptomyces avermitilis* enzyme ligated with 2-{hydroxy[2-nitro-4(trifluoromethyl)phenyl]methylene}cyclohexane-1,3-dione (Brownlee J M, et al. (2004) *Biochemistry* 43:6370-6377 PDB 1T47). This strategy was later expanded into residues of other secondary structure conformation as well. The criteria for position selection, backbone (N, C, C-alpha) atoms within 9 angstroms of the modeled inhibitor with side-chains facing away, included positions located in structural elements other than beta strands. See, Table 4.

TABLE 4

"beta-back" Structural Libraries

| Residue | WT residue | Designed Library |
|---------|------------|------------------|
| Beta-back library 1 | | |
| 216 | F | L, I, V, Y |
| 256 | G | A |
| 260 | M | I, V, K, A |
| 288 | T | S, E, D |
| 361 | V | A, L, I |
| 374 | T | S |
| 383 | L | F, V, I |
| 389 | Q | E, D, N |

TABLE 4-continued

"beta-back" Structural Libraries

| Residue | WT residue | Designed Library |
|---|---|---|
| 413 | K | Q, E |
| 418 | Q | E |
| Beta-back library 2 | | |
| 223 | V | A, S, T |
| 258 | N | T, M |
| 262 | L | I, V, M |
| 301 | M | I |
| 328 | A | S, P, D, T |
| 359 | V | A, L, I |
| 368 | V | T, F, L, Y |
| 382 | T | P |
| 385 | L | F, I, V |
| 417 | S | A, G, K |

Maize-Mesotrione Structural Model

The structural model of most interest for library design, that of a commercially available herbicidal inhibitor bound to the maize enzyme, was not available in the PDB. Therefore, a model was constructed from available structural data and termed it the maize-mesotrione model. The starting coordinates of maize HPPD were taken from the x-ray structure PDB:1SP8. The missing residues of 248-254 in the crystal structure were manually built using the conformation of the corresponding peptide in PDB:1T47 as a reference. The open conformation of helix 11 was manually created by rotating the phi- and psi-torsion angles in residues Asn415, Gly414 and Lys413. A preliminary structure of mesotrione was constructed using InsightII's MODELER module Discovery Studio 2.5 (Accelrys, San Diego) and parameters refined with Antechamber (Wang et. al. (2006) *Journal of Molecular Graphics and Modelling,* 25:247260) and manually docked into the maize HPPD active site analogously with NTBC in the *Streptomyces* structure (PDB:1T47). Energy minimization was performed using CHARMm (Chemistry at HARvard Macromolecular Mechanics, www.charmm.org) under various constraints to relax the structure gradually, first in vacuum with the crystal waters. The histidine protonation state, either on NE2 or ND 1, was determined based on the hydrogen bonding pattern of the crystal structure. The following libraries were designed from this model.

Substitutions Targeting the Cyclohexadiene Ring of Inhibitors of the Cyclohexane Dione Class One obvious strategy that the model revealed to selectively impede binding of cyclohexane dione inhibitors was to introduce substitutions into those beta strands that pass over the inhibitors' cyclohexadiene ring, a feature that is not present in the substrate. For "Hexring" library 1, two such strands were identified and targeted via semi-synthetic shuffling for changes to bulkier side chains of similar chemical properties, as shown in Table 5:

TABLE 5

"Hexring" library 1

| Position | Wild type AA | Designed changes |
|---|---|---|
| 219 | V | L, M, F, I |
| 220 | V | I, L, M |
| 221 | G | V, A, S, C |
| 259 | S | T, N, Y |
| 260 | M | I, L, F |

TABLE 5-continued

"Hexring" library 1

| Position | Wild type AA | Designed changes |
|---|---|---|
| 261 | V | I, L, F, M |
| 262 | L | I, F, W |

"Hexring" library 2 included positions in which a "heavy" atom (any other than hydrogen) of the side chain is within 5 Å of a heavy atom of the cyclohexadiene ring of mesotrione. These target only side chains that point toward the active site. All positions targeted have hydrophobic side chains. To maximize the chances of disrupting binding interactions, the designed changes introduced charged and polarized side chains in addition to bulkier hydrophobic side chains. See Table 6.

TABLE 6

"Hexring" library 2

| Residue | WT residue | Designed Library |
|---|---|---|
| 220 | V | Q, K, M, I, D, E, R, L, N |
| 245 | F | H, K, L, W, Y, E, R, I |
| 257 | L | W, E, R, K, H |
| 261 | V | R, N, I, D, L, Q, F, E, M, K |
| 270 | L | K, Q, N, R, E, D |
| 411 | F | W, I, L, E, D |

Substitutions Targeting the Methylsulfonyl and Nitro Substituents of Mesotrione, and the C-Terminal Tail of the Enzyme Mesotrione has substituents on the aromatic ring that distinguish it from the substrate, HPP. These include a nitro group at the 2-position and a methylsulfonyl at the 4-position. HPP has no substituent at the 2-position and at the 4-position has hydroxyl, which is much less bulky than methylsulfonyl. Further, due to its location near the entrance of the active site, it was postulated that the methylsulfonyl group affects inhibitor release. The designed substitutions were intended to disrupt hydrogen bonds between the enzyme and these substituents or increase the bulk of the side chains, to create steric hindrance. A similar rationale was applied to the nitro group.

The C-terminal helix is an amphipathic cylinder whose hydrophobic face packs over the active site in ligand-free structures, and which projects into the solvent in ligated structures (Yang C et al. (2004) *Biochemistry* 43:10414-10423, Fritze et al. (2004) *Plant Phys* 134: 1388-1400, 2004). The helix was therefore proposed to function as a gating mechanism (Fritze I et al. (2004) *Plant Phys* 134, 1388-1400). Amino acids within the helix were viewed and their contacts as possible determinants of the binding and release of both substrates and inhibitors and thus could affect both inhibitor binding affinity and catalytic efficiency. Substitutions were therefore designed to disrupt contacts with mesotrione (positions 282, 285, 299, 360, 384, 418, 419) or introduce additional flexibility on the tail helix (position 417). These designs were tested with the two libraries tabulated below. See, Table 7 and 8.

TABLE 7

"Tail" library

| Residue | WT residue | Designed Library |
|---------|------------|------------------|
| 254 | E | D, N, Q |
| 255 | S | T |
| 282 | R | G, K |
| 360 | L | M, I, V |
| 384 | F | L |
| 385 | L | F, I, V, M |
| 391 | I | L, V |
| 394 | M | L, V |
| 417 | S | K, G, T, R |
| 418 | Q | E, A, N, G, D |
| 425 | D | N, Q |
| 426 | Y | H, F |
| 431 | E | K, G, Q, D |

TABLE 8

"Remainder" library

| Residue | WT residue | Designed Library | Mesotrione moiety targeted |
|---------|------------|------------------|---------------------------|
| 285 | Q | W, A, N, L, V, I, R, E, K | Nitro |
| 299 | Q | W, A, N, L, V, I, R, E, K | Nitro |
| 384 | F | E, Y, V, W, A, D, S, Q, T | Nitro |
| 419 | L | I, D, F, E, V, S, W, T | Methylsulfonyl |

Example 4

Random and Site-Directed Mutagenesis

Random mutagenesis is a consequence of the shuffling process whose frequency can be manipulated but not completely eliminated. Random mutations offer the possibility of beneficial changes that could not be predicted. The frequency of random mutations was intentionally increased into the wild type and HPPD D0193494 genes by modifying the PCR conditions of various shuffling processes.

One of the best hits from the wild-type Random library, HPPD D0206042, had an excellent OFF rate ratio of 0.54 and a high $k_{cat}$ (Table 9). It had 6 substitutions relative to wild type. To produce a variant that combined the high ON rate ratio of HPPD D0193494 with the high OFF rate ratio of HPPD D0206042, the maize-mesotrione structural model was used to predict, based mainly on proximity to the active site, which of the 6 mutations in HPPD D0206042 were most likely to contribute to the high OFF rate ratio. Three were selected and introduced, individually and in combination, into the HPPD D0193494 gene by site-directed mutagenesis, and the enzymes evaluated. It was apparent that the R341C mutation (HPPD D0223903) was mainly responsible for the improved insensitivity. Further exploration of side chains with diverse chemical properties at position 341 reveals that glutamate (Table 9; HPPD D0223945, compared with HPPD D0223938) and isoleucine (Table 9; HPPD D0223935 compared with HPPD D0223903) were also effective. Another random mutation, G414D, was solely responsible for a 6.5-fold increase in insensitivity parameter (Table 9; HPPD D0205976 compared with wild type).

Screening the Tail library resulted in the discovery of two more positions that could be associated with beneficial effects in the wild-type backbone. When introduced into HPPD D0223903, the L360M mutation resulted in an increased OFF rate ratio (Table 9; HPPD D0223938 compared with HPPD D0223903). In variants with improved insensitivity, the S417A mutation restored $k_{cat}$ to the value seen in wild type (Table 9; HPPD D0223944 compared with HPPD D0223903; HPPD D0223946 compared with HPPD D0223945).

Example 5

Library Screening; Characterization of Shuffled HPPD Variants

Genes coding for shuffled variants of HPPD were cloned into the E. coli expression vector specified in Example 1 and introduced into E. coli. The library was plated out on rich agar medium, then individual colonies were picked and grown in rich medium in 96-well format. Colonies with active HPPD enzyme cause the medium to turn brown due to the conversion of homogentisate to ochronotic pigment (Zannoni V G et al. (1969) Biochim Biophys Acta. 177:94-105). Proteins with the ability to turn the media brown in the presence of 100 uM mesotrione were subjected to detailed analysis as described in Example 1. Protein production was induced in E. coli cultures by IPTG and the HPPD enzyme was purified by Ni NTA chromatography. Characteristics of ON rate, OFF rate, $k_{cat}$ and $K_m$ were determined as described previously for the maize and soy enzymes. Table 9 contains the kinetic and insensitivity characteristics for all improved HPPD protein variants.

Variants Improved in at Least One Parameter of Insensitivity

Improved (slower) rates of association of enzyme and mesotrione, manifested in the assay as a higher value for ON rate ratio (see Example 1), were readily attained. Values ranged from that of the wild type, 0.2, to 0.9, near the theoretical maximum value of 1.0. Improved (faster) rates of dissociation were less common, but variants with OFF rate ratios up to 0.76 were observed. Variants sufficiently improved in ON rate, OFF rate or both so as to result in improved insensitivity parameter (ON rate ratio×OFF rate ratio) include many with values in the range of 0.06 to 0.1 and several with values up to 0.38, representing 8-fold improved insensitivity compared to maize wild-type HPPD. No attempt was made to improve $k_{cat}$, but rather to find a sequence context in which improved insensitivity could be attained with little or no loss of enzyme turnover rate ($k_{cat}$) or catalytic efficiency ($k_{cat}/K_m$). This was achieved with several variants, for example those corresponding to HPPDs D0223944, D0223945, D0223946, and D0223947.

TABLE 9

Kinetic parameters of maize wild-type HPPD and improved variants

| | kcat min$^{-1}$ | Km uM | kcat/Km min$^{-1}$uM$^{-1}$ | ON rate ratio | OFF rate ratio | Insensitivity Parameter (ON × OFF) | Vmax MT min$^{-1}$ | OFF time sec | Ratio of Insensitivity Parameter | ON × OFF × kcat min$^{-1}$ |
|---|---|---|---|---|---|---|---|---|---|---|
| 1_MaizeWildType | 200.0 | 7.52 | 27.6 | 0.19 | 0.260 | 0.048 | 52.0 | 280 | 1.00 | 9.88 |
| 2_Soy|ABQ96868 | 100.0 | 3 | 33 | 0.20 | 0.010 | 0.002 | 1.0 | >720 | 0.04 | 0.20 |

TABLE 9-continued

Kinetic parameters of maize wild-type HPPD and improved variants

| | kcat min$^{-1}$ | Km uM | kcat/Km min$^{-1}$uM$^{-1}$ | ON rate ratio | OFF rate ratio | Insensitivity Parameter (ON × OFF) | Vmax MT min$^{-1}$ | OFF time sec | Ratio of Insensitivity Parameter | ON × OFF × kcat min$^{-1}$ |
|---|---|---|---|---|---|---|---|---|---|---|
| 3_D0223903 | 119.0 | 5.49 | 21.8 | 0.52 | 0.310 | 0.161 | 36.9 | 400 | 3.35 | 19.16 |
| 4_D0223935 | 124.0 | | | 0.54 | 0.400 | 0.216 | 49.6 | 80 | 4.50 | 26.78 |
| 5_D0223938 | 153.0 | 5.56 | 27.6 | 0.58 | 0.500 | 0.287 | 76.5 | 200 | 5.98 | 43.91 |
| 6_D0223944 | 231.0 | 6.16 | 37.5 | 0.55 | 0.50 | 0.274 | 114.3 | 120 | 5.70 | 63.19 |
| 7_D0223945 | 146.0 | 5.92 | 24.7 | 0.60 | 0.630 | 0.378 | 92.0 | 160 | 7.88 | 55.19 |
| 8_D0223946 | 247.0 | 6.61 | 37.2 | 0.52 | 0.495 | 0.257 | 122.3 | 80 | 5.36 | 63.58 |
| 9_D0223947 | 130.0 | 6.10 | 21.3 | 0.42 | 0.590 | 0.248 | 76.7 | 80 | 5.16 | 32.21 |
| 10_D0223948 | 125.0 | 623.00 | 0.2 | 0.74 | 0.640 | 0.475 | 80.0 | | 9.90 | 59.38 |
| 11_D0145011 | 139.0 | 6.39 | 21.8 | 0.40 | 0.108 | 0.043 | 15.0 | 480 | 0.90 | 5.98 |
| 12_D0145008 | 174.0 | 5.82 | 29.8 | 0.34 | 0.099 | 0.033 | 17.2 | 400 | 0.69 | 5.77 |
| 13_D0145322 | 86.0 | 3.97 | 21.6 | 0.44 | 0.124 | 0.055 | 10.7 | 360 | 1.15 | 4.68 |
| 14_D0145323 | 135.0 | 5.29 | 25.6 | 0.26 | 0.159 | 0.042 | 21.5 | 470 | 0.88 | 5.68 |
| 15_D0151212 | 60.7 | | | 0.42 | | | | | | |
| 16_D0151213 | 35.5 | | | 0.56 | | | | | | |
| 17_D0150898 | 37.1 | | | 0.58 | | | | | | |
| 18_D0154330 | 155.0 | 4.96 | 31.2 | 0.52 | 0.117 | 0.061 | 18.1 | 380 | 1.27 | 9.45 |
| 19_D0150900 | 50.0 | 2.67 | 18.9 | 0.70 | 0.182 | 0.127 | 9.2 | 420 | 2.65 | 6.41 |
| 20_D0151216 | 33.0 | | | 0.64 | | | | | | |
| 21_D0151217 | 44.9 | | | 0.61 | | | | | | |
| 22_D0151218 | 35.5 | | | 0.59 | | | | | | |
| 23_D0151215 | 109.7 | | | 0.45 | | | | | | |
| 24_D0151214 | 44.6 | | | 0.41 | | | | | | |
| 25_D0150903 | 47.1 | | | 0.53 | | | | | | |
| 26_D0150905 | 137.0 | 5.04 | 27.3 | 0.45 | 0.130 | 0.058 | 17.8 | 430 | 1.21 | 8.02 |
| 27_D0150906 | 96.0 | 4.82 | 20.0 | 0.47 | 0.142 | 0.067 | 13.7 | 510 | 1.40 | 6.49 |
| 28_D0150907 | 123.0 | 3.60 | 34.3 | 0.64 | 0.172 | 0.110 | 21.1 | 480 | 2.29 | 13.53 |
| 29_D0150909 | 116.0 | 4.40 | 26.3 | 0.49 | 0.143 | 0.070 | 16.5 | 370 | 1.46 | 8.10 |
| 30_D0150911 | 67.0 | | | 0.44 | | | | | | |
| 31_D0150912 | 112.0 | 3.23 | 34.7 | 0.64 | 0.162 | 0.104 | 18.1 | 370 | 2.17 | 11.67 |
| 32_D0151219 | 29.0 | | | 0.61 | | | | | | |
| 33_D0169796 | 36.1 | | | 0.80 | 0.063 | 0.050 | 2.3 | 680 | 1.04 | 1.82 |
| 34_D0169799 | 23.5 | | | 0.84 | 0.103 | 0.087 | 2.4 | 650 | 1.81 | 2.05 |
| 35_D0163602 | 29.5 | | | 0.81 | 0.085 | 0.069 | 2.5 | 650 | 1.44 | 2.03 |
| 36_D0182672 | 51.4 | 2.14 | 22.8 | 0.81 | 0.121 | 0.099 | 6.2 | 330 | 2.06 | 5.07 |
| 37_D0163580 | 21.8 | | | 0.92 | 0.067 | 0.062 | 1.5 | 590 | 1.29 | 1.34 |
| 38_D0180483 | 54.1 | 1.86 | 21.3 | 0.76 | 0.161 | 0.122 | 8.7 | 300 | 2.54 | 6.57 |
| 39_D0163573 | 36.2 | | | 0.68 | 0.085 | 0.058 | 3.1 | 600 | 1.21 | 2.09 |
| 40_D0182115 | 87.6 | 3.23 | 27.1 | 0.66 | 0.129 | 0.085 | 11.3 | 400 | 1.77 | 7.44 |
| 41_D0182116 | 74.0 | 3.59 | 20.6 | 0.59 | 0.099 | 0.058 | 7.3 | 400 | 1.21 | 4.31 |
| 42_D0182123 | 122.0 | 4.56 | 26.8 | 0.40 | 0.092 | 0.037 | 11.2 | 420 | 0.77 | 4.47 |
| 43_D0182125 | 95.1 | 3.20 | 29.7 | 0.45 | 0.116 | 0.052 | 11.1 | 430 | 1.08 | 4.98 |
| 44_D0182126 | 73.5 | 3.06 | 24.0 | 0.47 | 0.114 | 0.053 | 8.4 | 350 | 1.10 | 3.93 |
| 45_D0182128 | 74.2 | 2.53 | 29.3 | 0.56 | 0.153 | 0.086 | 11.3 | 380 | 1.79 | 6.34 |
| 46_D0181972 | 58.0 | 2.78 | 18.3 | 0.74 | 0.127 | 0.094 | 7.4 | 350 | 1.96 | 5.45 |
| 47_D0182429 | 20.0 | | | 0.57 | 0.230 | 0.131 | 4.6 | 510 | 2.73 | 2.62 |
| 48_D0182430 | 29.0 | | | 0.54 | 0.157 | 0.085 | 4.6 | 450 | 1.77 | 2.46 |
| 49_D0182431 | 28.0 | | | 0.62 | 0.138 | 0.085 | 3.9 | 535 | 1.77 | 2.39 |
| 50_D0182432 | 29.0 | | | 0.59 | 0.187 | 0.110 | 5.4 | 480 | 2.29 | 3.19 |
| 51_D0182433 | 57.0 | | | 0.50 | 0.086 | 0.043 | 4.9 | 505 | 0.90 | 2.46 |
| 52_D0182434 | 17.0 | | | 0.63 | 0.147 | 0.093 | 2.5 | 510 | 1.94 | 1.58 |
| 53_D0223785 | 98.1 | 3.57 | 27.5 | 0.51 | 0.158 | 0.080 | 15.5 | 460 | 1.67 | 7.86 |
| 54_D0223786 | 102.9 | 2.95 | 34.9 | 0.52 | 0.131 | 0.069 | 13.5 | 500 | 1.44 | 7.06 |
| 55_D0223787 | 95.6 | 2.60 | 36.8 | 0.58 | 0.134 | 0.078 | 12.8 | 490 | 1.63 | 7.42 |
| 56_D0182673 | 78.2 | 2.69 | 20.5 | 0.59 | 0.140 | 0.083 | 11.0 | 340 | 1.73 | 6.52 |
| 57_D0184038 | 186.6 | 7.34 | 25.4 | 0.61 | 0.145 | 0.088 | 27.0 | 550 | 1.83 | 16.38 |
| 58_D0223788 | 118.2 | 4.76 | 24.8 | 0.60 | 0.128 | 0.076 | 15.1 | 530 | 1.58 | 9.02 |
| 59_D0223789 | 63.8 | | | 0.68 | 0.126 | 0.086 | 8.1 | 500 | 1.79 | 5.49 |
| 60_D0223790 | 73.0 | | | 0.44 | 0.121 | 0.053 | 8.8 | 520 | 1.10 | 3.89 |
| 61_D0223220 | 72.8 | | | 0.66 | 0.124 | 0.082 | 9.0 | 550 | 1.71 | 5.98 |
| 62_D0223218 | 37.7 | | | 0.72 | 0.183 | 0.132 | 6.9 | 550 | 2.75 | 4.99 |
| 63_D0223221 | 68.3 | | | 0.68 | 0.110 | 0.075 | 7.5 | 520 | 1.56 | 5.14 |
| 64_D0223219 | 43.0 | | | 0.70 | 0.216 | 0.152 | 9.3 | 500 | 3.17 | 6.54 |
| 65_D0223222 | 40.4 | | | 0.75 | 0.165 | 0.124 | 6.7 | 500 | 2.58 | 5.02 |
| 66_D0223223 | 99.0 | | | 0.59 | 0.123 | 0.073 | 12.2 | 600 | 1.52 | 7.21 |
| 67_D0223224 | 32.7 | | | 0.73 | 0.165 | 0.120 | 5.4 | 460 | 2.50 | 3.92 |
| 68_D0223225 | 51.3 | | | 0.76 | 0.143 | 0.109 | 7.3 | 500 | 2.27 | 5.60 |
| 69_D0223226 | 51.9 | | | 0.79 | 0.173 | 0.137 | 9.0 | 500 | 2.85 | 7.10 |
| 70_D0223227 | 35.7 | | | 0.81 | 0.160 | 0.130 | 5.7 | 500 | 2.71 | 4.65 |
| 71_D0223228 | 63.4 | | | 0.69 | 0.127 | 0.087 | 8.0 | 500 | 1.81 | 5.53 |
| 72_D0223229 | 41.5 | | | 0.64 | 0.176 | 0.113 | 7.3 | 500 | 2.35 | 4.70 |
| 73_D0223230 | 25.8 | | | 0.68 | 0.187 | 0.127 | 4.8 | 420 | 2.65 | 3.28 |
| 74_D0223231 | 52.4 | | | 0.65 | 0.113 | 0.074 | 5.9 | 460 | 1.54 | 3.86 |
| 75_D0223232 | 24.8 | | | 0.74 | 0.166 | 0.123 | 4.1 | 450 | 2.56 | 3.04 |
| 76_D0182130 | 68.2 | 2.69 | 25.4 | 0.64 | 0.150 | 0.096 | 10.3 | 480 | 2.00 | 6.56 |

TABLE 9-continued

Kinetic parameters of maize wild-type HPPD and improved variants

| | kcat min$^{-1}$ | Km uM | kcat/Km min$^{-1}$uM$^{-1}$ | ON rate ratio | OFF rate ratio | Insensitivity Parameter (ON × OFF) | Vmax MT min$^{-1}$ | OFF time sec | Ratio of Insensitivity Parameter | ON × OFF × kcat min$^{-1}$ |
|---|---|---|---|---|---|---|---|---|---|---|
| 77_D0182132 | 24.0 | 2.76 | 8.7 | 0.71 | 0.320 | 0.227 | 7.7 | 330 | 4.73 | 5.44 |
| 78_D0182133 | 61.0 | | | 0.51 | 0.122 | 0.062 | 7.4 | 535 | 1.29 | 3.78 |
| 79_D0182134 | 56.0 | | | 0.69 | 0.124 | 0.086 | 7.0 | 500 | 1.79 | 4.80 |
| 80_D0182135 | 68.0 | | | 0.63 | 0.098 | 0.062 | 6.7 | 510 | 1.29 | 4.20 |
| 81_D0182136 | 70.0 | | | 0.51 | 0.122 | 0.062 | 8.6 | 530 | 1.29 | 4.37 |
| 82_D0182137 | 80.0 | | | 0.50 | 0.074 | 0.037 | 5.9 | 510 | 0.77 | 2.94 |
| 83_D0182138 | 81.0 | | | 0.48 | 0.098 | 0.047 | 8.0 | 500 | 0.98 | 3.83 |
| 84_D0182139 | 95.0 | | | 0.54 | 0.078 | 0.042 | 7.4 | 500 | 0.88 | 3.98 |
| 85_D0223237 | 36.5 | | | 0.54 | 0.127 | 0.068 | 4.6 | 360 | 1.42 | 2.50 |
| 86_D0223238 | 53.8 | | | 0.59 | 0.107 | 0.064 | 5.7 | 360 | 1.33 | 3.41 |
| 87_D0182147 | 35.6 | 4.60 | 8.7 | 0.62 | 0.071 | 0.044 | 2.5 | 140 | 0.92 | 1.57 |
| 88_D0182153 | 58.9 | | | 0.55 | 0.098 | 0.054 | 5.8 | 350 | 1.13 | 3.19 |
| 89_D0182441 | 42.0 | 2.12 | 21.6 | 0.53 | 0.126 | 0.066 | 5.3 | 400 | 1.38 | 2.79 |
| 90_D0182152 | 42.4 | | | 0.66 | 0.116 | 0.077 | 4.9 | 450 | 1.60 | 3.25 |
| 91_D0182443 | 40.1 | 3.65 | 12.0 | 0.62 | 0.066 | 0.041 | 2.6 | 200 | 0.85 | 1.64 |
| 92_D0182140 | 112.5 | 4.67 | 26.3 | 0.48 | 0.084 | 0.040 | 9.5 | 450 | 0.83 | 4.52 |
| 93_D0182142 | 112.3 | 4.41 | 32.8 | 0.55 | 0.093 | 0.051 | 10.4 | 450 | 1.06 | 5.72 |
| 94_D0182143 | 80.2 | | | 0.44 | 0.120 | 0.053 | 9.6 | 480 | 1.10 | 4.25 |
| 95_D0223233 | 59.8 | | | 0.53 | 0.077 | 0.041 | 4.6 | 400 | 0.85 | 2.45 |
| 96_D0223234 | 63.2 | | | 0.58 | 0.081 | 0.047 | 5.1 | 400 | 0.98 | 2.96 |
| 97_D0223235 | 49.6 | | | 0.53 | 0.080 | 0.042 | 4.0 | 340 | 0.88 | 2.08 |
| 98_D0223236 | 44.1 | | | 0.52 | 0.110 | 0.057 | 4.8 | 400 | 1.19 | 2.51 |
| 99_D0223791 | 85.5 | | | 0.52 | 0.083 | 0.043 | 7.1 | 500 | 0.90 | 3.67 |
| 100_D0223792 | 74.4 | | | 0.47 | 0.094 | 0.044 | 7.0 | 530 | 0.92 | 3.29 |
| 101_D0223793 | 68.1 | | | 0.65 | 0.095 | 0.062 | 6.5 | 490 | 1.29 | 4.22 |
| 102_D0187905 | 119.6 | 6.67 | 17.9 | 0.22 | 0.233 | 0.051 | 27.8 | 300 | 1.06 | 6.12 |
| 103_D0187903 | 136.5 | 6.53 | 20.9 | 0.15 | 0.235 | 0.035 | 32.1 | 80 | 0.73 | 4.81 |
| 104_D0188275 | 34.2 | 5.00 | 6.9 | 0.27 | 0.330 | 0.091 | 11.3 | 450 | 1.90 | 3.10 |
| 105_D0188380 | 156.3 | 9.42 | 16.6 | 0.12 | 0.186 | 0.022 | 29.0 | 200 | 0.46 | 3.50 |
| 106_D0188959 | 59.8 | 6.61 | 9.1 | 0.49 | 0.285 | 0.139 | 17.0 | 80 | 2.90 | 8.34 |
| 107_D0188964 | 47.0 | 4.76 | 9.9 | 0.43 | 0.211 | 0.091 | 9.9 | 120 | 1.90 | 4.30 |
| 108_D0188840 | 55.6 | 7.70 | 7.2 | 0.50 | 0.382 | 0.191 | 21.2 | 100 | 3.98 | 10.60 |
| 109_D0188843 | 53.9 | 6.55 | 8.2 | 0.44 | 0.254 | 0.111 | 13.7 | 180 | 2.31 | 5.96 |
| 110_D0189068 | 26.5 | 3.68 | 7.2 | 0.52 | 0.449 | 0.232 | 11.9 | 315 | 4.83 | 6.16 |
| 111_D0189091 | 93.3 | 4.76 | 19.6 | 0.25 | 0.297 | 0.074 | 27.7 | 190 | 1.54 | 6.90 |
| 112_D0189110 | 38.8 | 3.54 | 11.0 | 0.34 | 0.402 | 0.138 | 15.6 | 265 | 2.88 | 5.36 |
| 113_D0193300 | 69.5 | | | 0.43 | 0.227 | 0.097 | 15.8 | 493 | 2.02 | 6.73 |
| 114_D0193315 | 102.5 | | | 0.33 | 0.268 | 0.088 | 27.5 | 450 | 1.83 | 9.06 |
| 115_D0193305 | 80.8 | | | 0.43 | 0.207 | 0.089 | 16.7 | 580 | 1.85 | 7.22 |
| 116_D0193312 | 69.5 | | | 0.49 | 0.199 | 0.098 | 13.8 | 480 | 2.04 | 6.79 |
| 117_D0193342 | 58.8 | | | 0.36 | 0.328 | 0.117 | 19.3 | 400 | 2.44 | 6.85 |
| 118_D0193486 | 35.0 | | | 0.59 | 0.360 | 0.209 | 12.3 | 220 | 4.35 | 7.23 |
| 119_D0193494 | 117.0 | 4.30 | 27.5 | 0.61 | 0.160 | 0.098 | 18.7 | 110 | 2.04 | 11.42 |
| 120_D0193461 | 15.5 | | | 0.70 | 0.270 | 0.189 | 4.2 | 400 | 3.94 | 2.93 |
| 121_D0193482 | 23.0 | | | 0.65 | 0.380 | 0.247 | 8.6 | 320 | 5.15 | 5.60 |
| 122_D0193498 | 21.0 | | | 0.76 | 0.390 | 0.296 | 8.1 | 340 | 6.17 | 6.10 |
| 123_D0193655 | 43.0 | | | 0.42 | 0.400 | 0.166 | 17.3 | 180 | 3.46 | 7.20 |
| 124_D0193643 | 41.3 | | | 0.68 | 0.220 | 0.150 | 9.1 | 440 | 3.13 | 6.21 |
| 125_D0193657 | 26.0 | | | 0.61 | 0.370 | 0.224 | 9.7 | 380 | 4.67 | 5.92 |
| 126_D0193577 | 74.0 | | | 0.45 | 0.300 | 0.138 | 22.3 | 480 | 2.88 | 10.16 |
| 127_D0193585 | 25.0 | | | 0.57 | 0.270 | 0.154 | 6.9 | 320 | 3.21 | 3.90 |
| 128_D0193609 | 43.0 | | | 0.43 | 0.180 | 0.077 | 7.7 | 480 | 1.60 | 3.28 |
| 129_D0193556 | 58.0 | | | 0.38 | 0.320 | 0.119 | 18.3 | 240 | 2.48 | 6.88 |
| 130_D0193610 | 40.0 | | | 0.40 | 0.190 | 0.076 | 7.6 | 380 | 1.58 | 3.05 |
| 131_D0193626 | 27.5 | | | 0.63 | 0.240 | 0.151 | 6.6 | 310 | 3.15 | 4.16 |
| 132_D0193558 | 41.0 | | | 0.55 | 0.290 | 0.157 | 11.7 | 380 | 3.27 | 6.45 |
| 133_D0193596 | 24.0 | | | 0.49 | 0.220 | 0.108 | 5.3 | 280 | 2.25 | 2.61 |
| 134_D0193628 | 26.0 | | | 0.56 | 0.180 | 0.101 | 4.7 | 280 | 2.10 | 2.62 |
| 135_D0193629 | 15.0 | | | 0.73 | 0.150 | 0.107 | 2.1 | 320 | 2.23 | 1.57 |
| 136_D0193574 | 58.0 | | | 0.46 | 0.265 | 0.122 | 15.4 | 490 | 2.54 | 7.07 |
| 137_D0193630 | 33.0 | | | 0.45 | 0.250 | 0.111 | 8.3 | 420 | 2.31 | 3.69 |
| 138_D0193591 | 79.0 | | | 0.35 | 0.250 | 0.087 | 19.4 | 180 | 1.81 | 6.84 |
| 139_D0193584 | 25.0 | | | 0.74 | 0.270 | 0.201 | 6.8 | 480 | 4.19 | 5.03 |
| 140_D0193616 | 15.0 | | | 0.57 | 0.270 | 0.155 | 4.1 | 460 | 3.23 | 2.33 |
| 141_D0193632 | 39.0 | | | 0.46 | 0.230 | 0.106 | 9.0 | 220 | 2.21 | 4.13 |
| 142_D0223775 | 25.0 | | | 0.63 | 0.200 | 0.124 | 5.1 | 220 | 2.58 | 3.17 |
| 143_D0223776 | 15.0 | | | 0.61 | 0.210 | 0.127 | 3.1 | 300 | 2.65 | 1.89 |
| 144_D0223777 | 18.0 | | | 0.53 | 0.230 | 0.122 | 4.1 | 320 | 2.54 | 2.19 |
| 145_D0223778 | 20.0 | | | 0.57 | 0.230 | 0.130 | 4.5 | 340 | 2.71 | 2.55 |
| 146_D0223770 | 14.0 | | | 0.48 | 0.260 | 0.123 | 3.6 | 200 | 2.56 | 1.72 |
| 147_D0223779 | 28.0 | | | 0.48 | 0.260 | 0.123 | 7.3 | 320 | 2.56 | 3.48 |
| 148_D0223780 | 16.0 | | | 0.59 | 0.220 | 0.129 | 3.4 | 340 | 2.69 | 2.02 |
| 149_D0223771 | 39.0 | | | 0.55 | 0.200 | 0.108 | 7.6 | 280 | 2.25 | 4.18 |
| 150_D0223772 | 15.0 | | | 0.63 | 0.200 | 0.126 | 3.0 | 340 | 2.63 | 1.92 |

TABLE 9-continued

Kinetic parameters of maize wild-type HPPD and improved variants

| | kcat min$^{-1}$ | Km uM | kcat/Km min$^{-1}$uM$^{-1}$ | ON rate ratio | OFF rate ratio | Insensitivity Parameter (ON × OFF) | Vmax MT min$^{-1}$ | OFF time sec | Ratio of Insensitivity Parameter | ON × OFF × kcat min$^{-1}$ |
|---|---|---|---|---|---|---|---|---|---|---|
| 151_D0223773 | 19.0 | | | 0.52 | 0.240 | 0.126 | 4.5 | 340 | 2.63 | 2.33 |
| 152_D0223774 | 56.0 | | | 0.56 | 0.190 | 0.106 | 10.7 | 420 | 2.21 | 5.97 |
| 153_D0223781 | 43.0 | | | 0.37 | 0.310 | 0.116 | 13.4 | 220 | 2.42 | 5.02 |
| 154_D0223782 | 41.0 | | | 0.33 | 0.420 | 0.139 | 17.2 | 120 | 2.90 | 5.69 |
| 155_D0223783 | 23.0 | | | 0.58 | 0.330 | 0.193 | 7.5 | 400 | 4.02 | 4.35 |
| 156_D0223784 | 25.0 | | | 0.41 | 0.320 | 0.132 | 8.0 | 120 | 2.75 | 3.30 |
| 157_D0205976 | 50.4 | 412.00 | 0.1 | 0.56 | 0.570 | 0.319 | 20.0 | | 6.65 | 16.07 |
| 158_D0206042 | 118.0 | 12.30 | 9.6 | 0.14 | 0.540 | 0.076 | 36.7 | 80 | 1.58 | 8.92 |
| 159_D0223767 | 53.0 | | | 0.36 | 0.270 | 0.097 | 14.3 | 480 | 2.02 | 5.15 |
| 160_D0223768 | 42.0 | | | 0.50 | 0.420 | 0.209 | 17.5 | 340 | 4.35 | 8.72 |
| 161_D0223769 | 51.0 | | | 0.49 | 0.260 | 0.127 | 13.2 | 500 | 2.65 | 6.44 |
| 162_D0217072 | 62.4 | 11.80 | 5.3 | 0.17 | 0.580 | 0.099 | 47.0 | | 2.06 | 6.16 |
| 163_D0217068 | 9.0 | | | 0.06 | 0.760 | 0.046 | 6.8 | | 0.96 | 0.41 |
| 164_D0216957 | 34.0 | | | 0.66 | 0.270 | 0.178 | 9.2 | 420 | 3.71 | 6.06 |
| 165_D0223957 | 94 | | | 0.43 | 0.63 | 0.272 | 59.2 | | 5.67 | 25.57 |
| 166_D0223959 | 99 | | | 0.49 | 0.51 | 0.246 | 50.1 | | 5.13 | 24.35 |
| 167_D0223960 | 74 | | | 0.5 | 0.55 | 0.275 | 40.6 | | 5.73 | 20.35 |
| 168_D0223961 | 109 | 14 | 7.77 | 0.59 | 0.66 | 0.396 | 72.5 | 80 | 8.25 | 43.16 |
| 169_D0223962 | 176 | 20.2 | 8.74 | 0.53 | 0.73 | 0.392 | 130.0 | | 8.17 | 68.99 |
| 170_D0223963 | 129 | 16.9 | 7.62 | 0.5 | 0.77 | 0.386 | 100.0 | | 8.04 | 49.79 |
| 171_D0223964 | 85 | 9.8 | 8.74 | 0.54 | 0.72 | 0.391 | 61.6 | | 8.15 | 33.24 |

Summary of HPPD Diversity in Improved Variants

The inhibitor sensitivity of HPPD variants was quantified with the following parameters: ON rate ratio (defined in Example 1), OFF rate ratio (defined in Example 1), product of ON and OFF rate ratios (referred to as "insensitivity parameter ON×OFF"), the maximum reaction rate attained with mesotrione in the determination of OFF rate ratio (referred to as "Vmax MT") and triple multiplication product of ON rate ratio, OFF rate ratio and $k_{cat}$ (referred to as "ON×OFF×$k_{cat}$").

The variants in Table 9 were grouped according to the parameter in which they are improved compared to wild type. Their amino acid sequences within each group were aligned and the positions in which diversity is present are listed in Table 10. The sequence positions are numbered according to the wild-type maize amino acid sequence of SEQ ID 1. Some substitutions are effective in multiple contexts, as discussed in the next section.

TABLE 10

Collapsed diversity summary of HPPD Hits

A. Diversity associated with improved ON rate ratio

| | WT | Min | Max | Avg |
|---|---|---|---|---|
| ON rate | 0.19 | 0.22 | 0.92 | 0.56 |

| Position | 32 | 42 | 44 | 47 | 68 | 98 | 114 | 122 | 125 | 137 | 144 | 150 | 161 | 175 |
|---|---|---|---|---|---|---|---|---|---|---|---|---|---|---|
| WT | N | R | H | A | G | F | A | A | R | V | A | A | G | E |
| Diversity | R | H | L | S | A | L | S | T | S | I | V | S | S | G |
| Position | 184 | 187 | 193 | 202 | 207 | 209 | 219 | 221 | 226 | 233 | 241 | 253 | 260 | 261 |
| WT | Y | Y | G | G | G | A | I | G | L | F | E | A | M | V |
| Diversity | F | H | D | R | D | V | VLM | VASC | M | L | G | T | VIL | A |
| Position | 262 | 268 | 289 | 291 | 301 | 303 | 316 | 327 | 328 | 330 | 331 | 341 | 347 | 352 |
| WT | L | N | F | D | M | L | Q | M | A | P | T | R | T | K |
| Diversity | IW | G | Y | E | I | V | RK | L | P | R | P | CEI | S | NDE |
| Position | 360 | 377 | 383 | 387 | 414 | 417 | 418 | 425 | 437 | 438 | 440 | 442 | 443 | 444 |
| WT | L | V | L | I | G | S | Q | D | A | A | A | Q | G | S |
| Diversity | M | IL | F | M | ADHKR | G | E | E | P | E | TV | A | Q | G |

B. Diversity associated with improved OFF rate ratio

| | WT | Min | Max | Avg |
|---|---|---|---|---|
| OFF rate | 0.26 | 0.268 | 0.76 | 0.382 |

| Position | 32 | 47 | 68 | 114 | 146 | 175 | 207 | 209 | 211 | 219 | 221 | 253 | 260 | 261 |
|---|---|---|---|---|---|---|---|---|---|---|---|---|---|---|
| WT | N | A | G | A | D | E | G | A | Y | I | G | A | M | V |
| Diversity | R | S | A | S | V | G | D | V | C | VLM | VACS | T | LI | A |
| Position | 262 | 278 | 282 | 301 | 316 | 327 | 328 | 331 | 341 | 352 | 360 | 382 | 383 | 395 |
| WT | L | H | R | M | Q | M | A | T | R | K | L | T | L | E |
| Diversity | IW | R | K | I | R | L | P | P | ECI | N | M | A | F | G |
| Position | 405 | 414 | 417 | 440 | | | | | | | | | | |

TABLE 10-continued

Collapsed diversity summary of HPPD Hits

| WT | K | G | S | A |
|---|---|---|---|---|
| Diversity | E | ADHKR | G | T |

C. Diversity associated with improved ON × OFF

| | WT | Min | Max | Avg |
|---|---|---|---|---|
| ON × OFF | 0.049 | 0.05 | 0.378 | 0.121 |

| Position | 32 | 42 | 44 | 47 | 68 | 98 | 114 | 122 | 125 | 137 | 144 | 146 | 150 | 161 | |
|---|---|---|---|---|---|---|---|---|---|---|---|---|---|---|---|
| WT | N | R | H | A | G | F | A | A | R | V | A | D | A | G | |
| Diversity | R | H | L | S | A | L | S | T | S | I | V | V | S | S | |
| Position | 175 | 184 | 187 | 193 | 202 | 207 | 209 | 211 | 219 | 221 | 226 | 233 | 241 | 253 | |
| WT | E | Y | Y | G | G | G | A | Y | I | G | L | F | E | A | |
| Diversity | G | F | H | D | R | D | V | C | VLM | VASC | M | L | G | T | |
| Position | 260 | 261 | 262 | 268 | 278 | 289 | 291 | 301 | 303 | 316 | 327 | 328 | 331 | 341 | |
| WT | M | V | L | N | H | F | D | M | L | Q | M | A | T | R | |
| Diversity | LVI | A | IW | G | R | Y | E | I | V | RK | L | P | P | ECI | |
| Position | 347 | 352 | 360 | 377 | 383 | 387 | 395 | 405 | 414 | 417 | 437 | 440 | 442 | 443 | 444 |
| WT | T | K | L | V | L | I | E | K | G | S | A | A | Q | G | S |
| Diversity | S | NDE | M | IL | F | M | G | E | ADHKR | G | P | TV | A | Q | G |

D. Diversity associated with improved Vmax MT

| | WT | Min | Max | Avg |
|---|---|---|---|---|
| Vmax MT | 52.0 | 58.6 | 81.2 | 64.25 |

| Position | 68 | 175 | 261 | 301 | 327 | 328 | 331 | 341 | 352 | 360 | 383 | 414 | 417 | 440 |
|---|---|---|---|---|---|---|---|---|---|---|---|---|---|---|
| WT | G | E | V | M | M | A | T | R | K | L | L | G | S | A |
| Diversity | A | G | A | I | L | P | P | CE | N | M | F | AHKR | G | T |

E. Diversity associated with improved ON × OFF × $k_{cat}$

| | WT | Min | Max | Avg |
|---|---|---|---|---|
| ON × OFF × kcat | 9.88 | 10.11 | 94.5 | 29.10 |

| Position | 32 | 68 | 114 | 175 | 209 | 219 | 221 | 253 | 261 | 289 | 301 | 303 | 316 | 327 |
|---|---|---|---|---|---|---|---|---|---|---|---|---|---|---|
| WT | N | G | A | E | A | I | G | A | V | F | M | L | Q | M |
| Diversity | R | A | S | G | V | VL | A | T | A | Y | I | V | R | L |
| Position | 328 | 331 | 341 | 352 | 360 | 383 | 414 | 417 | 440 | | | | | |
| WT | A | T | R | K | L | L | G | S | A | | | | | |
| Diversity | P | P | ECI | N | M | F | ADHKR | G | T | | | | | |

HPPD Hit Diversity of Statistical Significance in Multiple-Contexts

The contributions of individual amino acid substitutions (collectively termed "diversity") toward the inhibitor insensitivity of HPPD depend on the backbone sequence in which the diversity is introduced. If the position is a strong determinant of a particular property, a substitution may have an effect in multiple sequence contexts. Statistical methods for detecting such substitutions are difficult to access. The shuffled HPPD gene products have 437-446 amino-acid residues. With a variant sequence having only 10 amino-acid substitution sites (97.7% sequence identity), the possible sequence diversity using all 20 amino acids is 20 to the power of 10, or 1.024×10^13. Measuring the contribution of individual substitutions introduced in such a huge number of backbone sequences is intractable without a statistical learning tool such as ProSAR (Fox R et al (2003) Protein Engineering 16, 589-597).

The core algorithm of ProSAR (Protein Sequence Activity Relationship) is Partial Least Square Regression (PLSR), which belongs to a large family of machine learning techniques. PLSR uses a principle component-based approach to reduce the number of variables toward the largest couple of components and builds models of adequate robustness. In ProSAR, diversity is encoded into random variables and PLSR is used to project them on the fitness parameter, in this case, herbicide insensitivity. The key statistic resulting from PLSR is similar to the regression coefficient resulting from canonical least squares regression. The PLSR coefficient is calculated for every amino-acid mutation in the sequence-activity data, indicating the contribution for a specific mutation toward the fitness parameter. Unlike regression where random variables have a prior assumption of independence, PLSR finds regression coefficient in multiple contexts. The substitutions having greater absolute values of regression coefficients and more statistical significance (measured by P-value) are predicted by ProSAR to contribute more to insensitivity even if introduced into multiple contexts.

Five ProSAR models were trained on the hit sequences and their correspondence to five fitness parameters is shown in Table 4. The diversity listed in the table is subject to the following criteria:
1. Normalized Regression coefficient greater than 10.
2. P-Value <0.1
3. Total count of mutations in hit sequences ≥3.

The ProSAR-selected diversity shown in Table 11 is a subset of the total cumulative diversity in Table 11, and represents a concentrated list of substitutions predicted to be of statistical significance in multiple sequence contexts. For diversity not in this list, the ProSAR statistics do not negate their contribution to herbicide insensitivity.

TABLE 11

Diversity predicted by ProSAR to improve fitness parameters in multiple sequence contexts
Summary of ProSAR Analysis

| | | | | | | | | |
|---|---|---|---|---|---|---|---|---|
| ON Rate Ratio | Position | 209 | 233 | 301 | 316 | 327 | 328 | 331 |
| | Maize Wild Type Residue | A | F | M | Q | M | A | T |
| | Diversity | V | L | I | R | L | P | P |
| | P-value | 2.008E−02 | 1.128E−09 | 6.625E−05 | 3.910E−07 | 1.794E−07 | 2.390E−05 | 1.707E−04 |
| | Normalized Absolute Regression Coefficient | 13.616 | 56.515 | 43.485 | 16.809 | 36.423 | 32.469 | 22.521 |
| OFF Rate Ratio | Position | 261 | 341 | 341 | 360 | 417 | | |
| | Maize Wild Type Residue | V | R | R | L | S | | |
| | Diversity | A | E | C | M | G | | |
| | P-value | 3.199E−02 | 1.436E−02 | 7.740E−02 | 3.535E−07 | 3.118E−03 | | |
| | Normalized Absolute Regression Coefficient | 23.146 | 27.749 | 23.999 | 72.251 | 31.395 | | |
| Insensitivity Parameter (ON × OFF) | Position | 233 | 261 | 301 | 328 | 331 | 360 | |
| | Maize Wild Type Residue | F | V | M | A | T | L | |
| | Diversity | L | A | I | P | P | M | |
| | P-value | 1.747E−02 | 3.146E−02 | 9.751E−02 | 5.240E−02 | 2.315E−02 | 1.815E−05 | |
| | Normalized Absolute Regression Coefficient | 18.434 | 20.668 | 17.260 | 13.997 | 16.000 | 45.934 | |
| Vmax MT | Position | 261 | 341 | 341 | 360 | 417 | | |
| | Maize Wild Type Residue | V | R | R | L | S | | |
| | Diversity | A | E | C | M | G | | |
| | P-value | 6.026E−08 | 4.042E−02 | 9.300E−02 | 2.385E−08 | 2.643E−02 | | |
| | Normalized Absolute Regression Coefficient | 40.022 | 33.818 | 27.009 | 66.182 | 34.195 | | |
| On × Off × kcat | Position | 261 | 341 | 360 | | | | |
| | Maize Wild Type Residue | V | R | L | | | | |
| | Diversity | A | E | M | | | | |
| | P-value | 1.586E−08 | 5.607E−02 | 1.068E−06 | | | | |
| | Normalized Absolute Regression Coefficient | 43.267 | 37.616 | 62.384 | | | | |

Example 6

Specific Substitutions Derived from Rational Design

Access to a structural model of the enzyme-inhibitor complex under investigation enabled discovery of several substitutions associated with improved insensitivity or catalytic efficiency, as listed in Table 12. Two of the design strategies described in Example 3, beta-back and methylsulfonyl contact, delivered higher herbicide tolerance, while a third, tail flexibility, as represented by the S417G substitution, restored $k_{cat}$ to wild type in sequence contexts where pursuit of higher insensitivity was associated with partially depressed $k_{cat}$.

TABLE 12

Rationally designed substitutions associated with improved fitness

| WT Residue | Hit Diversity | 2° structure | Min distance to inhibitor | Direction w.r.t. inhibitor |
|---|---|---|---|---|
| 301M | I | Sheet | 7.938 | Away |
| 328A | P | Coil | 8.713 | Away |
| 360L | M | Sheet | 4.22 | Toward |
| 417S | G | Helix | 6.054 | Away |

| WT Residue | Strategy Name | Design Principle |
|---|---|---|
| 301M | Beta-back | residues within 9 Å but not in direct contact with mesotrione |
| 328A | Beta-back | residues within 9 Å but not in direct contact with mesotrione |
| 360L | Methylsulfonyl | Contacting the methylsulfonyl group |
| 417S | Tail Flexibility | Provide flexibility to the tail helix |

Example 7

Measurement of $K_D$ by Isothermal Titration Calorimetry Validates Insensitivity Parameter To verify that the insensitivity parameter reflects improvement (elevation) in $K_D$, $K_D$ was directly measured with isothermal titration calorimetry. Maize wild type and D223903 HPPD were purified as described above. Enzymes were transferred to a matrix of 25 mM Hepes, pH 7, 2 mM ascorbate and 10 uM $FeSO_4$ by gel-filtration chromatography. Mesotrione or tembotrione were diluted into the same buffer. Enzyme concentrations in the cell ranged from 100 to 300 uM. Inhibitor concentrations in the syringe were always 8 times that of the cell concentration. The results are summarized in the Table 13.

TABLE 13

$K_D$ values for mesotrione and tembotrione in combination with wild-type maize HPPD and selected shuffled variants

|  | Sites modeled | $K_D$, nM | Fold vs wt |
|---|---|---|---|
| Mesotrione |  |  |  |
| Maize wt | One | 104 |  |
| D0223903 | One | 379 | 3.6 |
| Maize wt | Two | 33.3 |  |
| D0223903 | Two | 165 | 4.9 |
| Tembotrione |  |  |  |
| Maize wt | Two | 16.8 |  |
| D0223903 | Two | 123 | 7.3 |

The fold elevation in $K_D$ in the variant versus wild type is similar to the fold increase in the insensitivity parameter.

Example 8

Insensitivity to Mesotrione Confers Insensitivity to Other Herbicidal HPPD Inhibitors The same procedures for determining the insensitivity parameters for mesotrione (see Example 1) were used to monitor progressive insensitivity to other herbicidal HPPD inhibitors. The diketonitrile form of isoxaflutole is not commercially available and was synthesized by DuPont chemists. In every case, where the insensitivity parameter (ON rate ratio×OFF rate ratio) with mesotrione was elevated, similar or greater insensitivity was seen with the other inhibitors, as shown in Table 14A.

TABLE 14A

Insensitivity parameter (ON rate ratio × OFF rate ratio) for multiple herbicidal HPPD inhibitors, relative to that of maize wild-type HPPD

| Variant | Mesotrione | Sulcotrione | Topramezone | Tembotrione | Isoxaflutole (diketonitrile) |
|---|---|---|---|---|---|
| 1_MaizeWT | 1.0 | 1.0 | 1.0 | 1.0 | 1.0 |
| D0145323 | 1.0 | 1.0 | 1.6 |  | 1.6 |
| D0169796 | 1.2 | 3.2 | 30.1 |  | 25.3 |
| D0163580 | 1.5 | 1.8 | 22.0 |  | 17.3 |
| D0223223 | 1.7 | 1.8 | 2.7 |  | 3.4 |
| D0182115 | 2.0 | 2.6 | 10.8 |  | 9.9 |
| D0184038 | 2.1 | 1.1 | 0.5 |  | 0.9 |
| D0150912 | 2.5 | 1.9 | 7.7 |  | 11.9 |
| D0150907 | 2.6 | 2.5 | 6.0 |  | 4.6 |
| D0180483 | 2.8 | 3.3 | 21.7 |  | 16.8 |
| D0150900 | 3.0 | 2.4 | 19.2 |  | 20.9 |
| D0223218 | 3.1 | 2.7 | 18.8 |  | 20.9 |
| D0223226 | 3.2 | 2.5 | 11.3 |  | 13.6 |
| D0223219 | 3.6 | 1.2 | 22.4 |  | 21.2 |
| D0182132 | 5.4 | 3.7 | 35.8 |  | 43.6 |
| D0223903 | 6.0 | 3.3 | 12.7 | 19.3 | 12.3 |
| D0223944 | 6.5 | 4.7 | 9.3 | 7.4 | 5.3 |
| D0223946 | 6.5 | 4.4 | 7.8 | 6.6 | 5.5 |
| D0223938 | 7.4 | 4.6 | 12.4 | 15.1 | 8.5 |
| D0223945 | 7.7 | 5.2 | 15.2 | 18.1 | 9.9 |
| D0223947 | 7.8 | 5.3 | 15.5 | 18.9 | 11.3 |
| D0223948 | 20.1 | 9.9 | 33.3 | 24.9 | 16.3 |
| D0223972 | 15.9 | 8.0 | 41.7 | 35.4 | 63.6 |
| D0223973 | 6.5 | 3.8 | 11.3 | 5.9 | 13.6 |
| D0223975 | 9.3 | 4.8 | 16.6 | 14.5 | 17.6 |
| D0226660 | 13.1 | 6.2 | 38.7 | 39.0 | 62.3 |

High values for the insensitivity parameter is often associated with reduced catalytic turnover rate ($k_{cat}$). When $k_{cat}$ is taken into account by multiplying its value by the insensitivity parameter, the number of variants with values greater than that of wild-type HPPD is greatly reduced for mesotrione, but with other inhibitors, with most variants the reduction in $k_{cat}$ is more than compensated by the improved insensitivity.

TABLE 14B

Triple product (ON rate ratio × OFF rate ratio × $k_{cat}$) for multiple herbicidal HPPD inhibitors, relative to that of maize wild-type HPPD

| Variant | Mesotrione | Sulcotrione | Topramezone | Tembotrione | Isoxaflutole (diketonitrile) |
|---|---|---|---|---|---|
| D0163580 | 0.3 | 0.1 | 1.1 |  | 0.8 |
| D0169796 | 0.4 | 0.7 | 7.0 |  | 5.7 |
| D0223218 | 0.6 | 0.6 | 4.8 |  | 5.8 |
| D0145323 | 0.7 | 0.8 | 7.8 |  | 8.5 |
| D0182132 | 0.7 | 0.9 | 1.3 |  | 1.4 |
| D0150900 | 0.8 | 0.7 | 5.0 |  | 6.0 |

TABLE 14B-continued

Triple product (ON rate ratio × OFF rate ratio × $k_{cat}$) for multiple herbicidal HPPD inhibitors, relative to that of maize wild-type HPPD

| Variant | Mesotrione | Sulcotrione | Topramezone | Tembotrione | Isoxaflutole (diketonitrile) |
|---|---|---|---|---|---|
| D0180483 | 0.8 | 0.8 | 5.2 | | 4.5 |
| D0223219 | 0.8 | 0.4 | 6.6 | | 5.8 |
| D0223223 | 0.9 | 0.8 | 4.1 | | 4.7 |
| D0223226 | 0.9 | 1.6 | 1.6 | | 2.2 |
| D0182115 | 1.0 | 1.2 | 5.9 | | 5.0 |
| 1_MaizeWT | 1.0 | 1.0 | 1.0 | 1.0 | 1.0 |
| D0150912 | 1.5 | 1.0 | 3.8 | | 6.3 |
| D0150907 | 1.7 | 1.1 | 2.4 | | 2.3 |
| D0184038 | 2.1 | 0.9 | 0.4 | | 0.8 |
| D0223903 | 3.7 | 2.1 | 8.0 | 12.1 | 7.7 |
| D0223947 | 4.9 | 3.3 | 9.7 | 11.9 | 7.1 |
| D0223945 | 5.4 | 3.6 | 10.7 | 12.7 | 7.0 |
| D0223938 | 5.5 | 3.4 | 9.2 | 11.2 | 6.3 |
| D0223944 | 7.2 | 5.0 | 8.7 | 7.3 | 6.1 |
| D0223946 | 7.8 | 5.7 | 11.2 | 8.9 | 6.4 |
| D0223948 | 12.1 | 6.0 | 20.1 | 15.0 | 9.8 |
| D0223972 | 5.2 | 2.6 | 13.7 | 11.6 | 20.9 |
| D0223973 | 3.6 | 2.1 | 6.3 | 3.3 | 7.5 |
| D0223975 | 4.1 | 2.1 | 7.3 | 6.4 | 7.7 |
| D0226660 | 6.2 | 2.9 | 18.2 | 18.3 | 29.4 |

Example 9

Transformation of Soybean with Maize Wild-Type and Variant HPPD Genes

Soybean plants expressing HPPD variant transgenes were produced using the method of particle gun bombardment (Klein et al. (1987) Nature 327:70-73, U.S. Pat. No. 4,945, 050) using a DuPont Biolistic PDS1000/He instrument. A selectable marker gene used to facilitate soybean transformation was a chimeric gene composed of the 35S promoter from Cauliflower Mosaic Virus (Odell et al. (1985) Nature 313: 810-812), the hygromycin phosphotransferase gene from plasmid pJR225 (from E coli; Gritz et al. (1983) Gene 25:179-188) and the 3' region of the nopaline synthase gene from the T-DNA of the Ti plasmid of Agrobacterium tumefaciens. Another selectable marker used to facilitate soybean transformation was a chimeric gene composed of the S-adenosylmethionine synthase (SAMS) promoter (U.S. Pat. No. 7,741,537) from soybean, a highly resistant allele of ALS (U.S. Pat. Nos. 5,605,011, 5,378,824, 5,141,870, and 5,013, 659), and the native soy ALS terminator region. The selection agent used during the transformation process was either hygromycin or chlorsulfuron depending on the marker gene present. HPPD genes were expressed with a synthetic constitutive promoter, (for example U.S. Pat. Nos. 6,072,050 and 6,555,673), an HPPD variant, and an Arabidopsis ubiquitin3 gene terminator (Callis, J., et al. (1995) Genetics 139 (2), 921-939; Genbank L05363). In specific constructs, the SCP1 promoter of U.S. Pat. No. 6,072,050 was employed. Bombardments were carried out with linear DNA fragments purified away from any bacterial vector DNA. The selectable marker gene cassette was in the same DNA fragment as the HPPD cassette. Bombarded soybean embryogenic suspension tissue was cultured for one week in the absence of selection agent, then placed in liquid selection medium for 6 weeks. Putative transgenic suspension tissue was sampled for PCR analysis to determine the presence of the HPPD gene. Putative transgenic suspension culture tissue was maintained in selection medium for 3 weeks to obtain enough tissue for plant regeneration. Suspension tissue was matured for 4 weeks using standard procedures; matured somatic embryos were desiccated for 4-7 days and then placed on germination induction medium for 2-4 weeks. Germinated plantlets were transferred to soil in cell pack trays for 3 weeks for acclimatization. Plantlets were potted to 10-inch pots in the greenhouse for evaluation of herbicide resistance.

Example 10

Herbicide Spray Tests of Transgenic T0 HPPD Soy Plants Using Mesotrione

T0 plants with HPPD transgenes were grown to the V2 to V8 growth stage and then sprayed with commercial mesotrione formulation at a rate of 210 g ai/ha. All mesotrione treatments were applied with 0.25% nonionic surfactant and 1% ammonium sulfate in a spray volume of 374 L/ha. Individual plants were compared to untreated plants of similar genetic background, evaluated for herbicide response at eight days after treatment and assigned a visual response score from 0 to 100% injury (0=no effect to 100=dead plant). Expression of the HPPD gene varied due to the genomic location in the unique T0 plants. Some plants that did not express the HPPD gene were severely injured by the mesotrione. Other T0 plants created with the same DNA fragment showed tolerance to the mesotrione herbicide due to expression of the HPPD gene. The maize HPPD protein was found to be approximately 25 times more insensitive to mesotrione than the native soybean HPPD enzyme. Thus, it is not surprising that maize HPPD SEQ ID NO:1 provides moderate tolerance to mesotrione in T0 soybean plants. In the T0 generation, plants that had improved tolerance compared to controls based upon low injury scores were advanced to the T1 generation for more extensive herbicide testing. Some T0 plants were not sprayed with herbicide and were all advanced to the next generation for testing.

TABLE 15

Soybean T0 plants expressing HPPD gene variants. Plants were sprayed with the HPPD-inhibitor herbicide mesotrione and compared to control plants similarly treated. (nd: data not collected from plants)

| HPPD sequence | DNA | # of Treated Plants | Mean Soybean Response (% Injury) | Soybean % Injury Response Range |
|---|---|---|---|---|
| Elite soybean | none | 180 | 88 | 80-95 |
| Jack soybean | none | 186 | 87 | 75-95 |
| Maize wt | PHP34972A | 19 | nd | nd |
| D0145011 | PHP35360A | 30 | nd | nd |
| D0145322 | PHP35493A | 30 | nd | nd |
| D0145008 | PHP35490A | 26 | nd | nd |
| Maize wt | PHP38859A | 43 | nd | nd |
| D0150909 | PHP38860A | 25 | nd | nd |
| D0150900 | PHP38861A | 30 | nd | nd |
| D0145323 | PHP35494A | 36 | 54 | 30-90 |
| Maize wt | PHP38859A | 1 | 60 | 60 |
| D0184038 | PHP40545A | 45 | 41 | 10-95 |
| Maize wt | PHP41351A | 4 | 26 | 10-65 |
| D0182132 | PHP40546A | 19 | 63 | 20-98 |
| Maize wt | PHP41348A | 6 | 68 | 35-95 |
| Maize wt | PHP41350A | 22 | 57 | 15-90 |
| Maize wt | PHP41361A | 19 | 52 | 5-70 |
| D0189068 | PHP42106A | 9 | 67 | 45-80 |
| D0188959 | PHP42108A | 2 | 28 | 25-30 |
| D0193494 | PHP45012A | 5 | 53 | 40-65 |
| D0223903 | PHP45013A | 28 | 51 | 25-95 |
| D0184038 | PHP45143A | 25 | 48 | 15-95 |
| D0189068 | PHP45144A | 18 | 34 | 10-75 |
| D0188959 | PHP45145A | 30 | 45 | 5-85 |
| D0193494 | PHP45146A | 16 | 50 | 15-90 |
| D0223903 | PHP45147A | 24 | 31 | 0-65 |
| Maize wt | PHP45137A | 27 | 43 | 10-100 |
| D0193494 | PHP45139A | 28 | 57 | 25-100 |
| Maize wt | PHP45138A | 28 | 38 | 10-70 |
| D0223903 | PHP45920A | 13 | 50 | 15-90 |
| Maize wt | PHP45655A | 5 | 63 | 50-75 |
| Maize wt | PHP45656A | 12 | 57 | 15-95 |
| D0193494 | PHP45657A | 32 | 28 | 5-75 |
| D0193494 | PHP45659A | 7 | 31 | 10-65 |
| D0223903 | PHP45660A | 10 | 33 | 0-95 |
| D0223903 | PHP45662A | 15 | 51 | 10-95 |
| D0223903 | PHP45921A | 33 | 36 | 0-85 |
| D0223903 | PHP46018A | 26 | 49 | 15-75 |
| D0223903 | PHP46260A | 7 | 67 | 55-75 |
| D0223903 | PHP46262A | 1 | 0 | |
| D0223903 | PHP46263A | 16 | 42 | 0-90 |
| D0223903 | PHP46262A | 37 | 27 | 0-65 |
| D0223903 | PHP46526A | 14 | 52 | 5-80 |
| D0223903 | PHP46810A | 3 | 72 | 60-100 |
| D0223903 | PHP46902A | 7 | 34 | 5-65 |
| D0223946 | PHP47176A | 40 | 34 | 0-85 |
| D0223946 | PHP47177A | 24 | 64 | 10-85 |
| D0223946 | PHP47179A | 19 | 39 | 10-95 |
| D0223946 | PHP47180A | 41 | 46 | 5-90 |
| D0223946 | PHP47181A | 22 | 29 | 0-100 |
| D0223903 | PHP47091A | 14 | 61 | 45-100 |
| D0223972 | PHP47395A | 15 | 25 | 5-70 |
| D0223972 | PHP47396A | 39 | 42 | 10-95 |
| D0223961 | PHP48109A | 19 | 26 | 0-80 |
| D0226305 | PHP48225A | 16 | 41 | 0-90 |
| D0223961 trunc | PHP49250A | 9 | 39 | 0-100 |
| D0226660 | PHP50338A | 16 | 26 | 0-95 |
| D0226660 trunc | PHP50339A | 4 | 10 | 5-20 |

Example 11

Herbicide Spray Tests of Transgenic HPPD Soy Plants with Multiple HPPD-Inhibitor Herbicides T1 plants were evaluated for zygosity. Homozygous single-locus transgenic plants and their corresponding null segregants were identified and T2 true breeding seed was obtained from each. Plants were grown to the V1 to V2 growth stage and then sprayed with the commercial formulation of mesotrione, tembotrione, topramezone, and isoxaflutole. All treatments were applied with nonionic surfactant and ammonium sulfate in a spray volume of 374 L/ha. Multiple rates of each herbicide were applied so a response range could be used to compare the relative tolerance of the different herbicides as well as the relative tolerance of homozygous nulls and positives for each event. The herbicide response for individual treated plants was evaluated by comparing to untreated plants of similar genetic background. Herbicide response ratings were eight days after treatment. Visual injury was on a scale of 0 to 100% injury (0=no effect to 100=dead plant).

Example 12

Tolerance of Soy Plants Expressing Shuffled Maize HPPD and Maize NSF1

Transgenic soybean plants produced in the same manner as outlined in Example 9 may additionally contain a P450 gene that provides tolerance to HPPD-inhibitors by metabolism of the herbicide. The NSF1 gene (US 2007/0214515, US 2008/0052797) was included in a DNA fragment containing the HPPD variant and a marker gene and bombarded into soy embryogenic tissue as described in Example 9. The NSF1 expression cassette comprised the H2B promoter (Hagemann, K. et al., (2003) Plant Cell Rep. 21:569-576, U.S. Pat. No. 6,177,611)) and the Arabidopsis ubiquitin14 termination region (Genbank NM_178961 and NC_003075). T0 plants were tested for herbicide tolerance as in Example 10.

Figure 11:
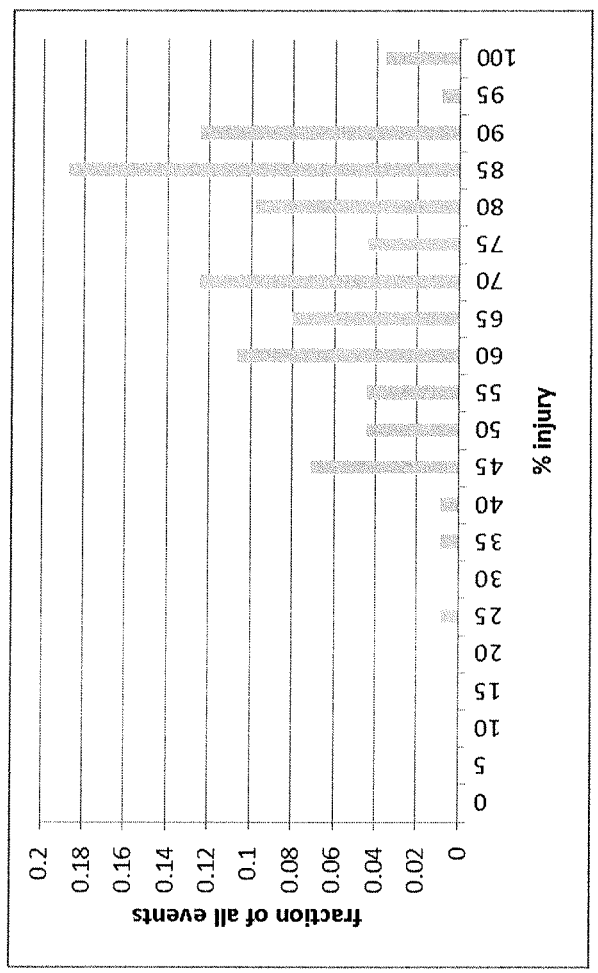
FIG. 11 shows the fraction of T0 events carrying an H2B-NSF1 cassette showing each injury score after spray with 2× Mesotrione. 0 indicates no visible injury while 100 indicates plant death.

Expression of the NSF1 gene by itself does not confer high level tolerance to the HPPD inhibitor Mesotrione. In one tested example including 112 T0 plants, the lowest injury score was 25%, but the mode was 85%. See FIG. 11.

Figure 12:
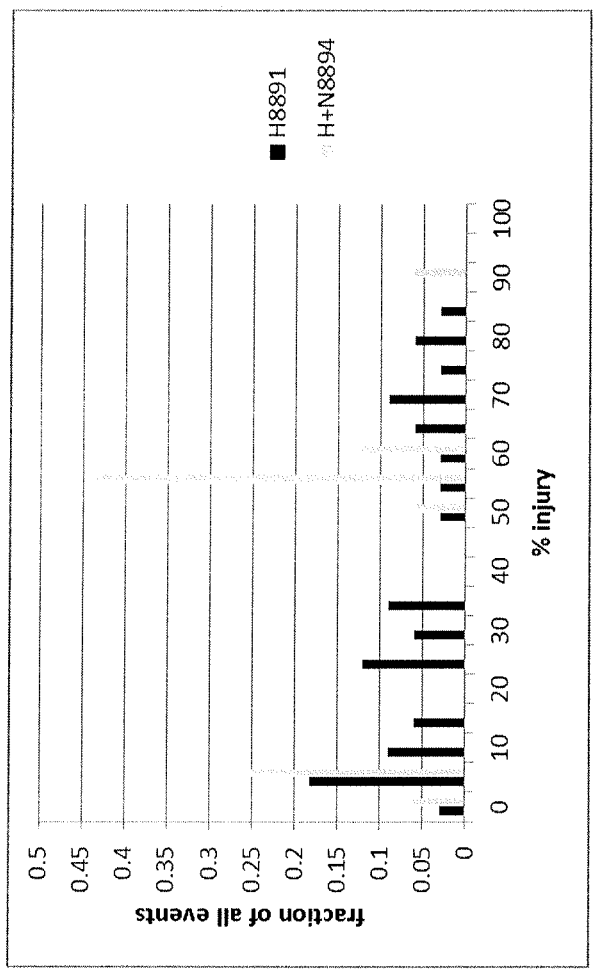
FIG. 12 shows the T0 events carrying an HPPD cassette alone (H8891) or the same HPPD cassette plus an NSF1 cassette (H+N8894) showing each injury score after spray with 2× Mesotrione. 0 indicates no visible injury while 100 indicates plant death.

While NSF1 alone does not confer high level tolerance to Mesotrione, it can in some circumstances enhance tolerance when expressed in conjunction with an insensitive HPPD. In one tested example the shuffled HPPD gene expression cassette alone conferred a relatively high level of tolerance to the inhibitor so that some T0 events showed no visible injury when sprayed with 2× Mesotrione. Another vector containing the same HPPD expression cassette and an H2B promoter-NSF1 cassette also produced T0 events that were uninjured when sprayed with 2× Mesotrione. See FIG. 12. As the percentage of total independent events showing zero injury in response to 2× Mesotrione was greater with the HPPD+NSF1 vector than for the HPPD alone vector, it appeared that NSF1 expression improved Mesotrione tolerance over expression of an insensitive HPPD alone.

Figure 13:
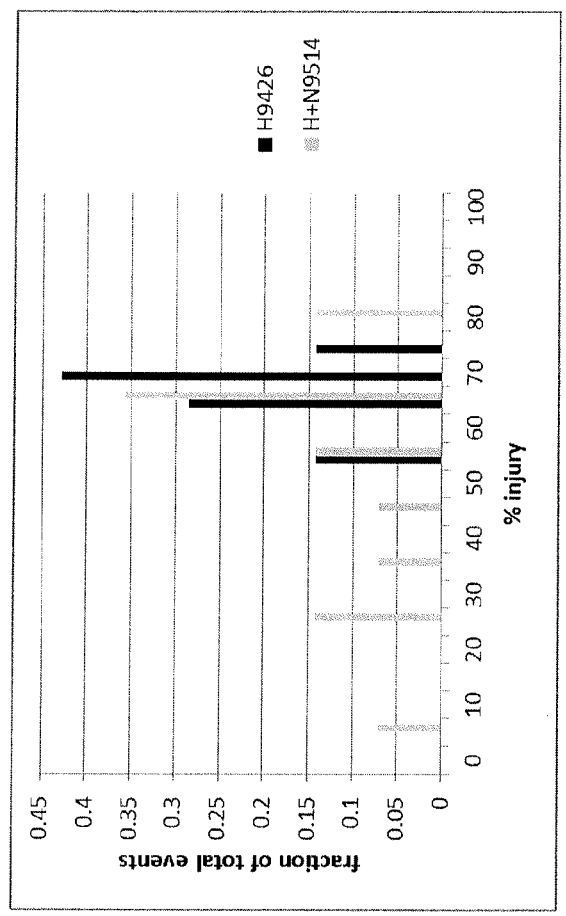
FIG. 13 shows the fraction of T0 events carrying an HPPD cassette alone (H9426) or the same HPPD cassette plus and NSF1 cassette (H+N9514) showing injury scores after spray with 2× Mesotrione. 0 indicates no visible injury while 100 indicates plant death.

In another tested example, a different HPPD cassette alone provided poor tolerance to T0 events sprayed with 2× Mesotrione, with the least injured score being 55%. When paired with an H2B promoter-NSF1 cassette, the same HPPD cassette produced events with as little as 5% injury. See FIG. 13.

Example 13

Production of Herbicide Tolerant Soybean Expressing HPPD Transgenes Introduced into the Chloroplast Genome Soybean plants with HPPD transgenes introduced into the chloroplast genome are produced using the method of particle gun bombardment (see Klein et al. (1987) Nature 327:70-73) using a DuPont Biolistic PDS1000/He instrument and vectors specifically designed to integrate into the chloroplast genome by homologous recombination. HPPD variants D0223946 and D0223961 had either 0, 20 or 23 N-terminal codons removed and replaced by a methionine (ATG) codon for translation initiation.

To accomplish chloroplast transformation of soybean with an HPPD gene, a vector is constructed that harbors regions of the chloroplast genome (FIG. 4). These chloroplast sequences, also termed homologous regions, flank the genes that are to be introduced into the chloroplast genome and direct the precise insertion of the transgenes into the chloroplast genome by homologous recombination. The homologous sequences used in the vector mediate transgene integration between the Gm-trnV and Gm-rps12/7 genes in the chloroplast genome. The vector contains two chimeric genes between the left and right homologous regions. The aadA gene encodes aminoglycoside 3"-adenylyltransferase. This protein can detoxify the antibiotic, spectinomycin. This gene is placed under control of the tobacco 16S ribosomal RNA promoter, Pan, and ribosome binding site from the rbcL gene at the 5' end and the terminator from the psbA gene at the 3' end (Svab et al. (1993) *Proceedings of the National Academy of Sciences of the United States of America* 90(3): 913-17). The HPPD gene is placed under the control of the tobacco psbA promoter at the 5' end and terminator from rps16 at the 3' end.

Soybean embryogenic suspension cultures are generated as for soy nuclear transformation (U.S. Pat. No. 7,763,778) and transformed with the soybean expression plasmids by the method of particle gun bombardment. A DNA plasmid fragment containing the gene of interest and the selectable marker gene is used for bombardment. Fragments from soybean expression plasmid is obtained by gel isolation of digested plasmids. In each case, 100 µg of plasmid DNA is used in 0.5 mL of the specific restriction enzyme mix. The resulting DNA fragments are separated by gel electrophoresis and the DNA was purified from the agarose using GELase digesting enzyme following the manufacturer's protocol. Purified DNA is coated onto gold particles and bombarded into the soy embryogenic tissue placed in an empty, sterile 60×15 mm petri dish and covered with plastic mesh.

Following bombardment, the tissue is maintained on agarose-solidified medium for two days. The tissue is then broken up and transferred to fresh agarose-solidified medium containing spectinomycin (300 mg/L). After 6 to 10 weeks, transplastomic tissue is recognized as small green clusters of globular stage somatic embryos. The green tissue is then transferred to liquid medium containing spectinomycin (300 mg/L). The tissue can then be analyzed by PCR for the presence of the transgene. PCR analysis can also be used to determine if the transgenic tissue still contains wild-type copies of the chloroplast genome or if the tissue is homoplasmic.

Positive embryos are allowed to mature and regenerate to form soy plantlets. The plantlets are rooted and transferred to soil. Transplastomic plants are sprayed with an HPPD-inhibitor herbicide and evaluated for tolerance.

Example 14

Maize HPPD has a Chloroplast Targeting Sequence

Bioinformatic Analysis of Maize HPPD

Maize HPPD proteins are not predicted to have a chloroplast targeting peptide N-terminal sequence. Analysis of the maize HPPD sequence by ProtComp 6.1 (linux1.softberry.com/berry.phtml), a widely used program for detecting organellar targeting sequences, indicates a cytosolic location of maize HPPD. The results returned by the search are as follows:
  Significant similarity in Location: Cytoplasmic
  Cytoplasmic core=14470
  Chloroplastic score 1.4
Activity of Truncated Forms of Maize HPPD:

Organellar targeting sequences are usually cleaved after the peptide enters the organelle. Previous investigators (Fritze I et al. (2004) Plant Physiology 134:1388-1400; Yang C et al. (2004) Biochemistry 43: 10414-10423) have shown that native mature maize HPPD begins at either ala17 or ala23. Variants of the wild-type maize HPPD gene coding for proteins were created with various lengths of the amino terminus removed, expressed the genes in *E. coli* and tested them for activity and stability. In each case a methionine start codon was added to the truncated sequence. Proteins are designated by the position of their N-terminal amino acid (all alanines) as in SEQ ID NO: 1. All N-terminal truncated proteins retained the HPPD activity. Differences in the measured $k_{cat}$ may not be significantly different as only a single measurement was taken for this experiment.

TABLE 16a

Activity of N-terminal truncated-variants of maize wild-type HPPD

| Truncation | kcat, min−1 |
| --- | --- |
| Maize wt | 166 |
| Ala12 | 230 |
| Ala15 | 177 |
| Ala17 | 180 |
| Ala20 | 128 |
| Ala23 | 184 |

To test stability, the variants were heated at various temperatures in the range of 20 C to 54 C for 30 minutes. The remaining activity was determined by the coupled assay described in a previous example. All variants were stable at 20 C, but activity declined with incubation temperatures over 30 C to nearly nil at 54 C. There were no differences in stability among wild type and all truncated variants.

Two other variants were truncated such that their second amino acid (after the N-terminal methionine) is ala20, and substrate saturation kinetic analysis was performed. No significant differences were found.

TABLE 16b

Kinetic parameters of variants truncated to ala20

| | Km, mM | kcat, min−1 | kcat/Km |
| --- | --- | --- | --- |
| D0223946 | 6.61 ± 0.84 | 247 ± 47.1 | 37.2 ± 2.39 |
| D0223946-ala20 | 6.86 ± 0.37 | 206 ± 20.5 | 30.2 ± 4.64 |
| D0223961 | 11.80 ± 0.99 | 106 ± 12.4 | 9.00 ± 0.29 |
| D0223961-ala20 | 11.38 ± 0.96 | 93.3 ± 5.41 | 8.22 ± 0.36 |

The N-Terminus of Maize HPPD Fused to DsRed is Targeted to Chloroplasts when Transiently Expressed in Maize Leaf A vector was constructed in which the portion of the maize HPPD gene coding for the N-terminal 50 amino acids was fused to the gene coding for *Discosoma* sp. red fluorescence protein 2 (DsRed2) and inserted into a binary expression vector under control of the maize Rubisco activase promoter (Liu et al. (1996) *Plant Physiol.* 112(1): 43-51) and terminated with the *Solanum tuberosum* proteinase inhibitor II (pinII) terminator region (An et al. (1989) *Plant Cell* 1:115-

122) with a hygromycin selection cassette. Both genes are between left and right border sequences from *Agrobacterium*.

A positive control vector was identical except that the insert was DsRed2 fused to the chloroplast targeting peptide of *Arabidopsis* rubisco activase, while a negative control was DsRed2 with no targeting sequence. The plasmids were transformed into *Agrobacterium tumefaciens* AGL-1. Leaves of 3-week old maize seedlings were infected with the *Agrobacterium*, and examined by fluorescence microscopy two days later (Nikon Eclipse 80i, DsRed filter set). With the vector where DsRed2 was fused to Rubisco activase CTP, the red fluorescence is seen in discrete packets in a pattern resembling peri-nuclear chloroplasts, as expected. A similar pattern was seen when DsRed2 was fused to the N-terminal 50 amino acids of maize HPPD. Without targeting, fluorescence is diffuse with some concentration in the nucleus. See FIG. 7.

Example 15

Saturation Mutagenesis of a Single Position in a Shuffled Maize Enzyme

One random mutation, G414D (D0205976), was solely responsible for a 6.5-fold increase in insensitivity parameter (ON×OFF), but had a 100× increase in Km for the substrate HPP. To explore whether other substitutions at this position would provide a similar increment of insensitivity with better kinetic parameters, a saturation mutagenesis was performed and measured kinetic and insensitivity parameters on the purified proteins. 12 of the 19 possible substitutions were evaluated. A small library was made with substitutions at this site. The backbone sequence into which the substitutions were generated was HPPD D0223944.

TABLE 17A

Kinetic and insensitivity parameters of substitutions at position 414

| Position 414 substitution | Km uM | kcat, min−1 | kcat/Km | ON rate ratio | OFF rate ratio | ON × OFF | Insensitivity parameter vs. wt | Vmax meso min−1 | ON × OFF × kcat/Km |
|---|---|---|---|---|---|---|---|---|---|
| D0223944 | 7.6 | 138 | 18.13 | 0.58 | 0.59 | 0.338 | 5.92 | 81 | 6.12 |
| G414A | 20.2 | 176 | 8.74 | 0.53 | 0.73 | 0.392 | 6.88 | 130 | 3.43 |
| G414D | 163.0 | 70 | 0.43 | 0.76 | 0.68 | 0.513 | 9.01 | 48 | 0.22 |
| G414F | 23.0 | 74 | 3.25 | 0.29 | 0.78 | 0.227 | 3.98 | 58 | 0.74 |
| G414H | 16.9 | 129 | 7.62 | 0.50 | 0.77 | 0.386 | 6.77 | 100 | 2.94 |
| G414K | 17.0 | 97 | 5.70 | 0.65 | 0.75 | 0.483 | 8.48 | 72 | 2.76 |
| G414M | 21.9 | 110 | 5.04 | 0.62 | 0.72 | 0.448 | 7.85 | 79 | 2.26 |
| G414Q | 24.1 | 140 | 5.79 | 0.54 | 0.73 | 0.391 | 6.85 | 101 | 2.26 |
| G414R | 9.8 | 85 | 8.74 | 0.54 | 0.72 | 0.391 | 6.85 | 62 | 3.41 |
| G414S | 11.3 | 51 | 4.54 | 0.51 | 0.53 | 0.267 | 4.68 | 27 | 1.21 |
| G414T | 18.4 | 112 | 6.09 | 0.46 | 0.75 | 0.346 | 6.07 | 84 | 2.11 |
| G414V | 36.9 | 91 | 2.48 | 0.25 | 0.61 | 0.150 | 2.63 | 55 | 0.37 |
| G414Y | 30.6 | 74 | 2.45 | 0.41 | 0.68 | 0.282 | 4.95 | 51 | 0.69 |

Substitutions at position 414 resulted in a wide range of $K_M$ values. Consequently, the parameter of overall performance, ON rate ratio×OFF rate ratio×$k_{cat}$ is not adequate, so it was replaced with ON×OFF×$k_{cat}$/$K_M$. Some general observations are that in the context of the D0223944 sequence, 1) insensitivity is not increased by the same increment as in the wild type context, 2) negative charge (D) elevates Km while positive charge (R,K) maintains nearly normal Km, 3) A,Q and H support highest $k_{cat}$, and 4) hydrophobic side chains (V,Y,F) and S are deleterious for insensitivity, especially on ON rate. The K, R, H and A substitutions represent the best combinations of insensitivity and catalytic activity.

TABLE 17B

Summary of variants described in Example 15

| Clone name | SEQ ID NO | Brief description of relationship to other HPPD variants herein |
|---|---|---|
| D0223957 (full length) | 383 | 8_D0223946 G414A |
| D0223959 (full length) | 384 | 3_D0223903 C341I L360M S417G G414A |
| D0223960 (full length) | 385 | 3_D0223903 C341I L360M S417G G414K |
| D0223961 (full length) | 386 | 6_D0223944 G414K |
| D0223962 (full length) | 387 | 6_D0223944 G414A |
| D0223963 (full length) | 388 | 6_D0223944 G414H |
| D0223964 (full length) | 389 | 6_D0223944 G414R |
| D0223957 (N-term truncate) | 397 | 8_D0223946 G414A |
| D0223959 (N-term truncate) | 398 | 3_D0223903 C341I L360M S417G G414A |
| D0223960 (N-term truncate) | 399 | 3_D0223903 C341I L360M S417G G414K |
| D0223961 (N-term truncate) | 400 | 6_D0223944 G414K |
| D0223962 (N-term truncate) | 401 | 6_D0223944 G414A |
| D0223963 (N-term truncate) | 402 | 6_D0223944 G414H |
| D0223964 (N-term truncate) | 403 | 6_D0223944 G414R |

Example 16

Identification of Novel HPPD Motifs

Table 18 provides a series of motifs (SEQ ID NOS:372-382 and 460-463) found in HPPD polypeptides having improved insensitivity to HPPD inhibitors. Table 18 further demonstrates which HPPD sequences set forth in SEQ ID NO: 3-164, 383-389 and 404-430 have the identified motif.

The HPPD motifs identified in SEQ ID NOS: 372-382 and 460-463 are determined to be important for HPPD variants that have improved herbicide tolerance. The motifs are created based on the list of diversity of statistical significance in multiple contexts (Table 11). A motif thus defined includes at least one of the statistically significant diversity, and the specific amino-acid combination defined by a motif is uniquely present only in the HPPD shuffled variants of improved insensitivity.

Non-consecutive motifs can also be defined with the unique diversity of the shuffled maize HPPD variants. The following list of single, double, and triple minimum amino acid substitutions are unique to the improved variants described in the examples compared to other known plant, bacterial, fungal, or animal HPPD proteins when optimally aligned with the maize HPPD protein. As discussed in further detail elsewhere herein, such non-consecutive HPPD motifs include, but are not limited to:

(a) An HPPD with equivalent of maize position 341C.
(b) An HPPD with equivalent of maize position 341C and one or more of 261A, 301I, 327L, 328P, 360M or 417G.
(c) An HPPD with equivalent of maize position 341E and one or more of 328P, 360M, or 417G.
(d) An HPPD with equivalent of maize position 417G and one or more of 327L, 331P or 360M.
(e) An HPPD with equivalent of maize position (261A and/or 301L) and 328 P and one or more of 360M or 417G.
(f) An HPPD with equivalent of maize position (261A and/or 327L) and 331P and 341E.
(g) An HPPD with equivalent of maize position 209V and 233L and one or more of 301I and 327L.
(h) An HPPD with equivalent of maize position 327L and 328P and one or more of 233L and 360M.

Additional non-consecutive HPPD motifs are set forth herein in Example 20.

TABLE 18

Unique sequence motifs present in HPPD variants with improved insensitivity

| MOTIF | Motif SEQ ID | Starting position in Maize WildType | Number of variants with motif | Variant ID(s) with motif |
|---|---|---|---|---|
| ASPGAV | (SEQ ID NO: 372) | 204 | 65 | 18_D0154330, 19_D0150900, 21_D0151217, 27_D0150906, 32_D0151219, 34_D0169799, 35_D0163602, 37_D0163580, 38_D0180483, 39_D0163573, 40_D0182115, 41_D0182116, 43_D0182125, 45_D0182128, 47_D0182429, 48_D0182430, 49_D0182431, 52_D0182434, 53_D0223785, 54_D0223786, 56_D0182673, 57_D0184038, 58_D0223788, 59_D0223789, 60_D0223790, 63_D0223221, 64_D0223219, 65_D0223222, 66_D0223223, 67_D0223224, 68_D0223225, 69_D0223226, 70_D0223227, 74_D0223231, 76_D0182130, 79_D0182134, 80_D0182135, 84_D0182139, 85_D0223237, 86_D0223238, 87_D0182147, 88_D0182153, 90_D0182152, 91_D0182443, 93_D0182142, 94_D0182143, 95_D0223233, 96_D0223234, 97_D0223235, 99_D0223791, 101_D0223793, 106_D0188959, 107_D0188964, 108_D0188840, 109_D0188843, 134_D0193628, 135_D0193629, 138_D0193591, 142_D0223775, 143_D0223776, 145_D0223778, 147_D0223779, 149_D0223771, 150_D0223772, 152_D0223774 |
| VVNVP | (SEQ ID NO: 373) | 220 | 3 | 104_D0188275, 110_D0189068, 112_D0189110 |
| AYLAG | (SEQ ID NO: 374) | 231 | 32 | D0254482, 19_D0150900, 33_D0169796, 34_D0169799, 35_D0163602, 36_D0182672, 37_D0163580, 38_D0180483, 40_D0182115, 47_D0182429, 48_D0182430, 49_D0182431, 50_D0182432, 52_D0182434, 62_D0223218, 64_D0223219, 65_D0223222, 67_D0223224, 69_D0223226, 70_D0223227, 71_D0223228, 72_D0223229, 73_D0223230, 75_D0223232, 76_D0182130, 78_D0182133, 87_D0182147, 88_D0182153, 89_D0182441, 90_D0182152, 91_D0182443, 101_D0223793 |
| SMAL | (SEQ ID NO: 375) | 259 | 48 | 386_D0223961, D0223970, D0223972, D0223973, D0223974, D0223975, D0226305, D0226660, D0227054, D0226899, D0227043, D0226473, D0254475, D0254476, D0254477, D0254478, D0254481, D0254482, D0254483, D0254485, D0254487, D0254489, D0254490, D0254491, D0254492, D0254493, D0254494, 387_D0223962, D0259077, D0259078, 388_D0223963, D0259079, D0259080, 389_D0223964, D0259081, D0259082, D0259083, D0259084, 3_D0223903, 4_D0223935, 5_D0223938, 6_D0223944, 7_D0223945, 8_D0223946, 9_D0223947, 10_D0223948, 119_D0193494, 164_D0216957 |
| IAVASD | (SEQ ID NO: 376) | 301 | 22 | 11_D0145011, 13_D0145322, 14_D0145323, 16_D0151213, 20_D0151216, 21_D0151217, 22_D0151218, 23_D0151215, 24_D0151214, 25_D0150903, 27_D0150906, 28_D0150907, 30_D0150911, 32_D0151219, 41_D0182116, 58_D0223788, 60_D0223790, 66_D0223223, 69_D0223226, 83_D0182138, 86_D0223238, 93_D0182142 |
| LPPPPS | (SEQ ID NO: 377) | 327 | 129 | 386_D0223961, D0223970, D0223973, D0223974, D0223975, D0226305, D0227054, D0226899, D0227043, 387_D0223962, D0259077, D0259078, 388_D0223963, D0259079, D0259080, 389_D0223964, D0259081, D0259082, D0259083, D0259084, 3_D0223903, 4_D0223935, 5_D0223938, 6_D0223944, 7_D0223945, 8_D0223946, 9_D0223947, 10_D0223948, 11_D0145011, 13_D0145322, 15_D0151212, 16_D0151213, 17_D0150898, 18_D0154330, 20_D0151216, 21_D0151217, 22_D0151218, 24_D0151214, 25_D0150903, 26_D0150905, 27_D0150906, 28_D0150907, 30_D0150911, 31_D0150912, 32_D0151219, 33_D0169796, 34_00169799, 35_D0163602, 36_D0182672, 37_D0163580, 38_D0180483, 39_D0163573, 40_D0182115, 41_D0182116, 42_D0182123, 43_D0182125, 44_D0182126, 45_D0182128, 46_D0181972, 47_D0182429, 48_D0182430, 49_D0182431, 50_D0182432, 51_D0182433, 52_D0182434, 53_D0223785, 54_D0223786, 55_D0223787, 56_D0182673, 58_D0223788, 59_D0223789, 60_D0223790, 61_D0223220, 62_D0223218, 63_D0223221, 64_D0223219, 65_D0223222, 66_D0223223, 67_D0223224, 68_D0223225, 69_D0223226, 70_D0223227, |

TABLE 18-continued

Unique sequence motifs present in HPPD variants with improved insensitivity

| MOTIF | Motif SEQ ID | Starting position in Maize WildType | Number of variants with motif | Variant ID(s) with motif |
|---|---|---|---|---|
| | | | | 71_D0223228, 72_D0223229, 73_D0223230, 74_D0223231, 75_D0223232, 77_D0182132, 79_D0182134, 80_D0182135, 81_D0182136, 82_D0182137, 83_D0182138, 84_D0182139, 85_D0223237, 86_D0223238, 92_D0182140, 93_D0182142, 94_D0182143, 95_D0223233, 96_D0223234, 97_D0223235, 98_D0223236, 99_D0223791, 100_D0223792, 119_D0193494, 120_D0193461_D0193602, 121_D0193482, 122_D0193498, 123_D0193655, 124_D0193643_D0193579_D0193615, 125_D0193657, 127_D0193585, 131_D0193626_D0193572, 134_D0193628, 135_D0193629, 139_00193584, 142_D0223775, 143_D0223776, 144_D0223777, 145_D0223778, 146_D0223770, 149_D0223771, 150_D0223772, 151_D0223773, 152_D0223774, 155_D0223783, 156_D0223784, 164_D0216957 |
| MPPPPS | (SEQ ID NO: 378) | 327 | 17 | 14_D0145323, 19_D0150900, 23_D0151215, 29_D0150909, 57_D0184038, 76_D0182130, 78_D0182133, 87_D0182147, 88_D0182153, 89_D0182441, 90_D0182152, 91_D0182443, 101_D0223793, 106_D0188959, 107_D0188964, 108_D0188840, 109_D0188843 |
| RREAG | (SEQ ID NO: 379) | 339 | 4 | 7_D0223945, 8_D0223946, 9_D0223947, 10_D0223948 |
| RRCAG | (SEQ ID NO: 380) | 339 | 41 | 386_D0223961, D0223970, D0223972, D0223973, D0223974, D0223975, D0226305, D0226660, D0227054, D0226899, D0227043, D0254473, D0254475, D0254476, D0254477, D0254478, D0254481, D0254482, D0254483, D0254485, D0254487, D0254489, D0254490, D0254491, D0254494, 387_D0223962, D0259077, D0259078, 388_D0223963, D0259079, D0259080, 389_D0223964, D0259081, D0259082, D0259083, D0259084, 3_D0223903, 5_D0223938, 6_D0223944, 158_D0206042, 164_D0216957 |
| GVMV | (SEQ ID NO: 381) | 358 | 44 | 386_D0223961, D0223970, D0223972, D0223973, D0223974, D0223975, D0226305, D0226660, D0227054, D0226899, D0227043, D0254473, D0254475, D0254476, D0254477, D0254478, D0254481, D0254482, D0254483, D0254485, D0254487, D0254489, D0254490, D0254491, D0254492, D0254493, 387_D0223962, D0259077, D0259078, 388_D0223963, D0259079, D0259080, 389_D0223964, D0259081, D0259082, D0259083, D0259084, 5_D0223938, 6_D0223944, 7_D0223945, 8_D0223946, 9_D0223947, 10_D0223948, 162_D0217072 |
| NFGQ | (SEQ ID NO: 382) | 415 | 40 | 386_D0223961, D0223970, D0223972, D0223973, D0223974, D0223975, D0226305, D0226660, D0227054, D0226899, D0227043, D0254473, D0254475, D0254476, D0254477, D0254478, D0254481, D0254482, D0254483, D0254485, D0254487, D0254489, D0254490, D0254491, D0254492, D0254493, D0254494, 387_D0223962, D0259077, D0259078, 388_D0223963, D0259079, D0259080, 389_D0223964, D0259081, D0259082, D0259083, D0259084, 6_D0223944, 8_D0223946 |
| AY[MC]A | (SEQ ID NO: 461) | 231 | 20 | D0223972, D0223973, D0223974, D0223975, D0226660, D0227054, D0226899, D0254473, D0254475, D0254476, D0254477, D0254478, D0254487, D0254489, D0254490, D0254491, D0254492, D0254493, D0254494, D0254481 |
| LPPP[LGQH]S | (SEQ ID NO: 462) | 327 | 18 | D0223972, D0226660, D0254473, D0254475, D0254476, D0254477, D0254478, D0254481, D0254482, D0254483, D0254485, D0254487, D0254492, D0254493, D0254494, D0254489, D0254490, D0254491 |
| RRDAG | (SEQ ID NO: 463) | 339 | 1 | D0254492 |
| K[KAHRFMQSVY]NF | (SEQ ID NO: 464) | 413 | 9 | D0223961, D0223962, D0223963, D0223964, D0259078, D0259079, D0259080, D0259081, D0259083, D0259084 |

The bracketed amino acids ([]) denote any amino acid residue that can be present at the position.

TABLE 19

Summary of SEQ ID NOS

| SEQ ID NO | Description |
|---|---|
| 1 | Amino acid sequence of the wild-type *Zea mays* HPPD |
| 2 | Amino acid sequence of the wild-type *Glycine max* HPPD (no CTP) |
| 3-164; 383-389 | Amino acid sequences of various full length HPPD variants |
| 165-326; 397-403 | Amino acid sequences of various N-terminal truncated HPPD variants |
| 327 | N-terminal truncation of the wild-type maize HPPD |
| 328 | Amino acid sequence of the wild-type *Hordeum vulgare* HPPD |
| 329 | Amino acid sequence of the wild-type *Avena sativa* HPPD |
| 330 | Amino acid sequence of the wild-type *Oryza sativa* HPPD |
| 331 | Amino acid sequence of the wild-type *Triticum aestivum* HPPD |
| 332 | Amino acid sequence of the wild-type *Daucus carota* HPPD |
| 333 | Amino acid sequence of the wild-type *Solenosteman sautellarioides* HPPD |
| 334 | Amino acid sequence of the wild-type *Picea Sitchensis* HPPD |
| 335 | Amino acid sequence of the wild-type *Abution theophrasti* HPPD |
| 336 | Amino acid sequence of the wild-type *Arabidopsis thaliana* HPPD |
| 337 | Amino acid sequence of the wild-type *Brassica rapa* HPPD |
| 338 | Amino acid sequence of the wild-type *Coptis japonica* HPPD |
| 339 | Amino acid sequence of the wild-type *Vitis vinifera* HPPD |
| 340 | Amino acid sequence of the wild-type *Medicago truncatula* HPPD |
| 341-369 | Various N-terminal regions of HPPDs |
| 370 | Modified region of maize HPPD |
| 371 | N-term CTP of wild-type maize HPPD |
| 372-382 | Various HPPD motif sequences |
| 391 | Native HPPD sequence from *Streptomyces avermitilis* GenBank: ABF50055 |
| 392 | Maize WT HPPD (from WO1997049816 SEQ ID NO: 11) |
| 393 | variant of *Sorghum bicolor* HPPD |
| 394 | Native *Sorghum bicolor* HPPD |
| 395 | Variant of *Glycine max* HPPD |
| 396 | Native *Glycine max* HPPD |
| 404-430 | Amino acid sequences of various full length HPPD variants |
| 431-457 | Amino acid sequences of various N-terminal truncated HPPD variants |
| 458-459 | Synthetic HPPD variants |
| 460-463 | Various HPPD motif sequences |
| 464 | CTP from soybean HPPD |
| 465 | Full length soybean HPPD (with CTP) |
| 466-489 | Various HPPD polypeptides |

TABLE 20

SEQ ID NO summary for the HPPD variants

| HPPD variant name | SEQ ID NO for full length sequence | SEQ ID NO for N-terminal truncated sequence |
|---|---|---|
| 3_D0223903 | 3 | 165 |
| 4_D0223935 | 4 | 166 |
| 5_D0223938 | 5 | 167 |
| 6_D0223944 | 6 | 168 |
| 7_D0223945 | 7 | 169 |
| 8_D0223946 | 8 | 170 |
| 9_D0223947 | 9 | 171 |
| 10_D0223948 | 10 | 172 |
| 11_D0145011 | 11 | 173 |
| 12_D0145008 | 12 | 174 |
| 13_D0145322 | 13 | 175 |
| 14_D0145323 | 14 | 176 |
| 15_D0151212 | 15 | 177 |
| 16_D0151213 | 16 | 178 |
| 17_D0150898 | 17 | 179 |
| 18_D0154330 | 18 | 180 |
| 19_D0150900 | 19 | 181 |
| 20_D0151216 | 20 | 182 |
| 21_D0151217 | 21 | 183 |
| 22_D0151218 | 22 | 184 |
| 23_D0151215 | 23 | 185 |
| 24_D0151214 | 24 | 186 |
| 25_D0150903 | 25 | 187 |
| 26_D0150905 | 26 | 188 |
| 27_D0150906 | 27 | 189 |
| 28_D0150907 | 28 | 190 |
| 29_D0150909 | 29 | 191 |
| 30_D0150911 | 30 | 192 |
| 31_D0150912 | 31 | 193 |
| 32_D0151219 | 32 | 194 |
| 33_D0169796 | 33 | 195 |
| 34_D0169799 | 34 | 196 |
| 35_D0163602 | 35 | 197 |
| 36_D0182672 | 36 | 198 |
| 37_D0163580 | 37 | 199 |
| 38_D0180483 | 38 | 200 |
| 39_D0163573 | 39 | 201 |
| 40_D0182115 | 40 | 202 |
| 41_D0182116 | 41 | 203 |
| 42_D0182123 | 42 | 204 |
| 43_D0182125 | 43 | 205 |
| 44_D0182126 | 44 | 206 |
| 45_D0182128 | 45 | 207 |
| 46_D0181972 | 46 | 208 |
| 47_D0182429 | 47 | 209 |
| 48_D0182430 | 48 | 210 |
| 49_D0182431 | 49 | 211 |
| 50_D0182432 | 50 | 212 |
| 51_D0182433 | 51 | 213 |
| 52_D0182434 | 52 | 214 |
| 53_D0223785 | 53 | 215 |
| 54_D0223786 | 54 | 216 |
| 55_D0223787 | 55 | 217 |
| 56_D0182673 | 56 | 218 |
| 57_D0184038 | 57 | 219 |
| 58_D0223788 | 58 | 220 |
| 59_D0223789 | 59 | 221 |
| 60_D0223790 | 60 | 222 |
| 61_D0223220 | 61 | 223 |
| 62_D0223218 | 62 | 224 |
| 63_D0223221 | 63 | 225 |
| 64_D0223219 | 64 | 226 |
| 65_D0223222 | 65 | 227 |
| 66_D0223223 | 66 | 228 |
| 67_D0223224 | 67 | 229 |
| 68_D0223225 | 68 | 230 |
| 69_D0223226 | 69 | 231 |
| 70_D0223227 | 70 | 232 |
| 71_D0223228 | 71 | 233 |
| 72_D0223229 | 72 | 234 |
| 73_D0223230 | 73 | 235 |
| 74_D0223231 | 74 | 236 |
| 75_D0223232 | 75 | 237 |
| 76_D0182130 | 76 | 238 |
| 77_D0182132 | 77 | 239 |
| 78_D0182133 | 78 | 240 |

TABLE 20-continued

SEQ ID NO summary for the HPPD variants

| HPPD variant name | SEQ ID NO for full length sequence | SEQ ID NO for N-terminal truncated sequence |
|---|---|---|
| 79_D0182134 | 79 | 241 |
| 80_D0182135 | 80 | 242 |
| 81_D0182136 | 81 | 243 |
| 82_D0182137 | 82 | 244 |
| 83_D0182138 | 83 | 245 |
| 84_D0182139 | 84 | 246 |
| 85_D0223237 | 85 | 247 |
| 86_D0223238 | 86 | 248 |
| 87_D0182147 | 87 | 249 |
| 88_D0182153 | 88 | 250 |
| 89_D0182441 | 89 | 251 |
| 90_D0182152 | 90 | 252 |
| 91_D0182443 | 91 | 253 |
| 92_D0182140 | 92 | 254 |
| 93_D0182142 | 93 | 255 |
| 94_D0182143 | 94 | 256 |
| 95_D0223233 | 95 | 257 |
| 96_D0223234 | 96 | 258 |
| 97_D0223235 | 97 | 259 |
| 98_D0223236 | 98 | 260 |
| 99_D0223791 | 99 | 261 |
| 100_D0223792 | 100 | 262 |
| 101_D0223793 | 101 | 263 |
| 102_D0187905 | 102 | 264 |
| 103_D0187903 | 103 | 265 |
| 104_D0188275 | 104 | 266 |
| 105_D0188380 | 105 | 267 |
| 106_D0188959 | 106 | 268 |
| 107_D0188964 | 107 | 269 |
| 108_D0188840 | 108 | 270 |
| 109_D0188843 | 109 | 271 |
| 110_D0189068 | 110 | 272 |
| 111_D0189091 | 111 | 273 |
| 112_D0189110 | 112 | 274 |
| 113_D0193300 | 113 | 275 |
| 114_D0193315 | 114 | 276 |
| 115_D0193305 | 115 | 277 |
| 116_D0193312 | 116 | 278 |
| 117_D0193342 | 117 | 279 |
| 118_D0193486 | 118 | 280 |
| 119_D0193494 | 119 | 281 |
| 120_D0193461 | 120 | 282 |
| 121_D0193482 | 121 | 283 |
| 122_D0193498 | 122 | 284 |
| 123_D0193655 | 123 | 285 |
| 124_D0193643 | 124 | 286 |
| 125_D0193657 | 125 | 287 |
| 126_D0193577 | 126 | 288 |
| 127_D0193585 | 127 | 289 |
| 128_D0193609 | 128 | 290 |
| 129_D0193556 | 129 | 291 |
| 130_D0193610 | 130 | 292 |
| 131_D0193626 | 131 | 293 |
| 132_D0193558 | 132 | 294 |
| 133_D0193596 | 133 | 295 |
| 134_D0193628 | 134 | 296 |
| 135_D0193629 | 135 | 297 |
| 136_D0193574 | 136 | 298 |
| 137_D0193630 | 137 | 299 |
| 138_D0193591 | 138 | 300 |
| 139_D0193584 | 139 | 301 |
| 140_D0193616 | 140 | 302 |
| 141_D0193632 | 141 | 303 |
| 142_D0223775 | 142 | 304 |
| 143_D0223776 | 143 | 305 |
| 144_D0223777 | 144 | 306 |
| 145_D0223778 | 145 | 307 |
| 146_D0223770 | 146 | 308 |
| 147_D0223779 | 147 | 309 |
| 148_D0223780 | 148 | 310 |
| 149_D0223771 | 149 | 311 |
| 150_D0223772 | 150 | 312 |
| 151_D0223773 | 151 | 313 |
| 152_D0223774 | 152 | 314 |
| 153_D0223781 | 153 | 315 |
| 154_D0223782 | 154 | 316 |
| 155_D0223783 | 155 | 317 |
| 156_D0223784 | 156 | 318 |
| 157_D0205976 | 157 | 319 |
| 158_D0206042 | 158 | 320 |
| 159_D0223767 | 159 | 321 |
| 160_D0223768 | 160 | 322 |
| 161_D0223769 | 161 | 323 |
| 162_D0217072 | 162 | 324 |
| 163_D0217068 | 163 | 325 |
| 164_D0216957 | 164 | 326 |
| D0223961 | 404 | 431 |
| D0223970 | 405 | 432 |
| D0223972 | 406 | 433 |
| D0223973 | 407 | 434 |
| D0223974 | 408 | 435 |
| D0223975 | 409 | 436 |
| D0226305 | 410 | 437 |
| D0226660 | 411 | 438 |
| D0227054 | 412 | 439 |
| D0226899 | 413 | 440 |
| D0227043 | 414 | 441 |
| D0254473 | 415 | 442 |
| D0254475 | 416 | 443 |
| D0254476 | 417 | 444 |
| D0254477 | 418 | 445 |
| D0254478 | 419 | 446 |
| D0254481 | 420 | 447 |
| D0254482 | 421 | 448 |
| D0254483 | 422 | 449 |
| D0254485 | 423 | 450 |
| D0254487 | 424 | 451 |
| D0254489 | 425 | 452 |
| D0254490 | 426 | 453 |
| D0254491 | 427 | 454 |
| D0254492 | 428 | 455 |
| D0254493 | 429 | 456 |
| D0254494 | 430 | 457 |
| GE010082 | 458 | |
| GE010083 | 459 | |

Example 17

Improvement of HPPD Proteins by Introduction of the Consecutive and Non-Consecutive Motifs of Improved HPPD Proteins The amino acid substitutions identified during the shuffling and mutagenesis of the maize HPPD gene can be made at analogous positions in other HPPD proteins to improve the insensitivity toward HPPD-inhibitor herbicides. The sequences can be optimally aligned and the motif substitutions made to the new HPPD sequences. The designed proteins can be made by creating synthetic corresponding gene sequences or by site directed mutagenesis of the nucleotide sequences encoding the new template genes. For example the *Sorghum bicolor* HPPD gene can be altered to encode an improved HPPD variant with the motifs of Example 16. Similarly an improved soybean (*Glycine max*) HPPD protein can be made with the motifs of Example 16 as shown in FIG. 9 or as in FIG. 14. The proteins are expressed in *E. coli* and characterized as in Example 1, transformed into plants as in Example 9 or 12, and characterized for herbicide tolerance in plants as described in Examples 10 and 11.

Example 18

Improvement of HPPD Proteins by Introduction of the Consecutive and Non-Consecutive Motifs of Improved Maize HPPD Proteins The amino acid substitutions identified during the shuffling and mutagenesis of the maize HPPD gene can be made at analogous positions in other HPPD proteins to improve their insensitivity toward HPPD-inhibiting herbicides. The sequences of native and improved maize HPPD were aligned with those of sorghum (Genbank accession number XP002453359) and soybean (Genbank accession number ABQ96868), and the motif substitutions were designed accordingly, as shown in FIG. 14. The genes designed for improvement were synthesized commercially, inserted into vector pVER7062 and expressed, purified and evaluated as in Example 1.

Example 19

Improved HPPD Variant Confers Tolerance to Multiple HPPD Inhibitor Herbicides T1 soybean plants expressing D0223903 (SEQ ID NO: 3) driven by a synthetic promoter (as described in U.S. Pat. No. 6,072,050) were evaluated with qPCR for the presence of the transgene and null and positive segregants selected. Plants were sprayed at the V1 growth stage with the commercial formulations of mesotrione, tembotrione, topramezone, and isoxaflutole. Two rates of each herbicide were applied foliarly with nonionic surfactant and ammonium sulfate in a spray volume of 374 L/ha. The herbicide response for individual plants was determined by comparing to untreated plants of similar genetic background. Visual injury was on a scale of 0 to 100% injury (0=no effect to 100=dead plant). The results in Table 22 are the means of two replicates and show that the transgene increased soybean tolerance to four different HPPD-inhibitor herbicides.

TABLE 21

Amino acid substitutions conferring reduced sensitivity to inhibitors in maize HPPD also confer reduced sensitivity in HPPD from soybean and sorghum.

| HPPD Sequence | Enzyme | Kinetic parameters | | | Mesotrione insensitivity parameters | | | |
|---|---|---|---|---|---|---|---|---|
| | | kcat | Km | kcat/Km | ON ratio | OFF ratio | ON × OFF Value | Fold vs wt |
| SEQ ID NO: 1 | wt maize | 201 | 5.20 | 38.8 | 0.189 | 0.255 | 0.048 | |
| D0226660 SEQ ID NO: 411 | variant maize | 110 | 4.46 | 24.7 | 0.674 | 0.722 | 0.487 | 10.1 |
| SEQ ID NO: 2 | wt soy | 83 | 2.00 | 41.8 | 0.299 | 0.135 | 0.040 | |
| GE010082 SEQ ID NO: 458 | improved soy | 13 | 14.0 | 0.92 | 0.444 | 0.219 | 0.097 | 2.41 |
| SEQ ID NO: 394 | wt *sorghum* | 246 | 4.90 | 50.2 | 0.227 | 0.199 | 0.045 | |
| GE010083 SEQ ID NO: 459 | improved *sorghum* | 87 | 5.35 | 16.3 | 0.634 | 0.436 | 0.277 | 6.13 |

| HPPD Sequence | Enzyme | Tembotrione insensitivity parameters | | | |
|---|---|---|---|---|---|
| | | ON ratio | OFF ratio | ON × OFF Value | Fold vs wt |
| SEQ ID NO: 1 | wt maize | 0.232 | 0.037 | 0.0087 | |
| D0226660 SEQ ID NO: 411 | variant maize | 0.750 | 0.109 | 0.0815 | 9.41 |
| SEQ ID NO: 2 | wt soy | 0.102 | 0.044 | 0.0044 | |
| GE010082 SEQ ID NO: 458 | improved soy | 0.321 | 0.070 | 0.0224 | 5.10 |
| SEQ ID NO: 394 | wt *sorghum* | 0.210 | 0.032 | 0.0067 | |
| GE010083 SEQ ID NO: 459 | improved *sorghum* | 0.730 | 0.071 | 0.0517 | 7.71 |

The data in Table 21 show that the amino acid substitutions defined as consecutive or non-consecutive motifs have similar effects when inserted into the HPPD protein of other plant species. The *G. max* HPPD protein was improved 2.41-fold for mesotrione and 5.10-fold with tembotrione. The *S. bicolor* HPPD protein was improved 6.13-fold with mesotrione and 7.71-fold with tembotrione. GE010883 is set forth as SEQ ID NO: 459 and GE010082 is set forth as SEQ ID NO: 458.

TABLE 22

Plants transformed with HPPD transgene show tolerance to multiple herbicides.

| Soybean Description | Herbicide | Rate (g ai/ha) | Null Soybean Response (% Injury) | Positive Soybean Response (% Injury) |
|---|---|---|---|---|
| Elite Line | Untreated | 0 | 0 | |
| Nontransgenic | Mesotrione | 105 | 65 | |
| | | 210 | 75 | |

TABLE 22-continued

Plants transformed with HPPD transgene show tolerance to multiple herbicides.

| Soybean Description | Herbicide | Rate (g ai/ha) | Null Soybean Response (% Injury) | Positive Soybean Response (% Injury) |
|---|---|---|---|---|
| | Tembotrione | 105 | 70 | |
| | | 210 | 78 | |
| | Topramezone | 26.25 | 78 | |
| | | 52.5 | 78 | |
| | Isoxaflutole | 13.12 | 70 | |
| | | 26.25 | 72 | |
| PHP45921A D0223903 SEQ ID NO: 3 | Untreated | 0 | 0 | 0 |
| | Mesotrione | 105 | 80 | 10 |
| | | 210 | 83 | 20 |
| | Tembotrione | 105 | 75 | 40 |
| | | 210 | 75 | 33 |
| | Topramezone | 26.25 | 75 | 5 |
| | | 52.5 | 78 | 20 |
| | Isoxaflutole | 13.12 | 80 | 15 |
| | | 26.25 | 78 | 5 |

Example 20

Saturation Mutagenesis of Individual Positions in Shuffled Maize HPPD

ProSAR analysis of the diversity that confers a beneficial effect on any of the kinetic or insensitivity parameters compiled in Example 5, Table 9 and Example 21, Table 26 revealed those substitutions that are beneficial in multiple sequence contexts (Table 11), implying their higher degree of impact. To be sure that those sites were fully exploited, we performed saturation mutagenesis at selected sites into the D0226660 backbone. Kinetic and insensitivity parameters were measured as described in Example 1. As shown in Table 23, multiple substitutions at six positions yielded variants with kinetic or insensitivity parameters nearly as good as or better than the backbone sequence.

TABLE 23

Kinetic and insensitivity parameters of variants made through saturation mutagenesis at selected positions in D0226660.

| | | Kinetic parameters | | | Insensitivity parameters, mesotrione | | | | ON × OFF × | |
|---|---|---|---|---|---|---|---|---|---|---|
| | Substitution | kcat min−1 | Km uM | kcat/Km | ON ratio | Off ratio | ON × OFF | Insens vs. wt | Vmax with mesotrione | kcat/Km min−1uM−1 |
| Mz wt | Seq ID 1 | 242 | 5.61 | 44.0 | 0.193 | 0.230 | 0.0444 | | 87.5 | 1.95 |
| | D0226660 | 114 | 3.96 | 28.9 | 0.611 | 0.678 | 0.415 | 9.34 | 130 | 12.0 |
| Q44I | D0254473 | 52.1 | 2.66 | 19.6 | 0.617 | 0.627 | 0.386 | 8.70 | 50.0 | 7.57 |
| Q44C | D0254475 | 52.9 | 3.17 | 16.7 | 0.657 | 0.646 | 0.425 | 9.57 | 70.4 | 7.09 |
| Q44S | D0254476 | 77.5 | 3.38 | 22.9 | 0.649 | 0.624 | 0.406 | 9.13 | 90.9 | 9.29 |
| Q44G | D0254477 | 81.7 | 3.35 | 24.4 | 0.648 | 0.618 | 0.401 | 9.03 | 94.2 | 9.77 |
| Q44V | D0254478 | 72.9 | 4.24 | 17.2 | 0.687 | 0.613 | 0.421 | 9.48 | 84.3 | 7.24 |
| M233C | D0254481 | 71.1 | 3.88 | 18.3 | 0.671 | 0.618 | 0.415 | 9.34 | 77.5 | 7.59 |
| M233L | D0254482 | 65.9 | 3.51 | 18.8 | 0.669 | 0.780 | 0.522 | 11.8 | 83.5 | 9.81 |
| M233I | D0254483 | 77.1 | 3.01 | 25.6 | 0.612 | 0.700 | 0.428 | 9.64 | 79.2 | 11.0 |
| M233V | D0254485 | 85.1 | 4.29 | 19.8 | 0.636 | 0.664 | 0.422 | 9.51 | 82.0 | 8.38 |
| Q316K | D0254487 | 77.9 | 2.89 | 26.9 | 0.650 | 0.848 | 0.551 | 12.4 | 96.5 | 14.9 |
| Q316R | D0223972 | 79.3 | 2.74 | 29.0 | 0.670 | 0.749 | 0.502 | 11.3 | 130 | 14.6 |
| L331G | D0254489 | 81.2 | 3.77 | 21.6 | 0.599 | 0.797 | 0.478 | 10.8 | 93.5 | 10.3 |
| L331Q | D0254490 | 85.0 | 4.77 | 17.8 | 0.581 | 0.779 | 0.453 | 10.2 | 87.9 | 8.07 |
| L331H | D0254491 | 79.9 | 3.95 | 20.2 | 0.583 | 0.741 | 0.432 | 9.73 | 79.5 | 8.73 |
| C341D | D0254492 | 70.2 | 3.78 | 18.6 | 0.712 | 0.885 | 0.630 | 14.2 | 91.4 | 11.7 |
| C341A | D0254493 | 64.7 | 3.07 | 21.1 | 0.703 | 0.815 | 0.573 | 12.9 | 79.1 | 12.1 |
| M360L | D0254494 | 52.7 | 3.11 | 16.9 | 0.747 | 0.712 | 0.532 | 12.0 | 57.1 | 9.01 |

The amino acids at the selected positions in wild type maize HPPD (SEQ ID NO: 1) are: H44, F233, Q316, T331, R341 and L360.

Thus, further provided is an HPPD polypeptide having the amino acid residue in the encoded polypeptide that corresponds to amino acid position 44 of SEQ ID NO:1 comprises a histidine, amino acid position 233 of SEQ ID NO:1 comprises a phenylalanine; the amino acid residue corresponding to amino acid position 316 of SEQ ID NO:1 comprises a glutamine, the amino acid residue corresponding to amino acid position 331 of SEQ ID NO:1 comprises a threonine, the amino acid residue corresponding to amino acid position 341 of SEQ ID NO:1 comprises a arginine, and the amino acid residue corresponding to amino acid position 360 of SEQ ID NO:1 comprises a lysine.

Example 21

Additional Summary of HPPD Diversity in Improved Variants

The same analysis as stated in Example 5 is conducted on all variants in Table 9 and Table 25. The resulting Table 24A-E summarizes the totality of diversity that is present in variants with improved insensitivity parameters, which are also defined in Example 5.

TABLE 24A

Diversity associated with improved ON rate ratio

On-Rate Ratio

| Position | 32 | 40 | 42 | 44 | 46 | 47 | 68 | 71 | 98 | 114 | 120 | 122 | 125 | 137 | 144 | 150 |
|---|---|---|---|---|---|---|---|---|---|---|---|---|---|---|---|---|
| MaizeHPPD | N | S | R | H | L | A | G | A | F | A | A | A | R | V | A | A |
| Diversity | R | A | H | VGQSCLI | V | S | A | V | L | S | P | T | S | I | V | S |

| Position | 161 | 167 | 175 | 184 | 187 | 193 | 202 | 207 | 209 | 219 | 221 | 225 | 226 | 233 | 241 | 253 |
|---|---|---|---|---|---|---|---|---|---|---|---|---|---|---|---|---|
| MaizeHPPD | G | R | E | Y | Y | G | G | G | A | I | G | E | L | F | E | A |
| Diversity | S | G | G | F | H | D | R | D | V | VLM | VASC | D | M | VCLMI | G | T |

| Position | 260 | 261 | 262 | 268 | 289 | 291 | 301 | 303 | 316 | 320 | 327 | 328 | 330 | 331 | 341 | 347 |
|---|---|---|---|---|---|---|---|---|---|---|---|---|---|---|---|---|
| MaizeHPPD | M | V | L | N | F | D | M | L | Q | A | M | A | P | T | R | T |
| Diversity | VLI | A | WI | G | Y | E | I | V | RK | S | L | P | R | GQPLH | DEACI | S |

| Position | 352 | 360 | 377 | 383 | 387 | 414 | 417 | 418 | 425 | 437 | 438 | 440 | 442 | 443 | 444 |
|---|---|---|---|---|---|---|---|---|---|---|---|---|---|---|---|
| MaizeHPPD | K | L | V | L | I | G | S | Q | D | A | A | A | Q | G | S |
| Diversity | DEN | M | LI | F | M | DTFVQASRMHYK | G | E | E | P | E | TVK | A | Q | G |

TABLE 24B

Diversity associated with improved OFF rate ratio

Off-Rate Ratio

| Position | 32 | 40 | 44 | 46 | 68 | 71 | 98 | 114 | 120 | 146 | 167 | 175 | 207 | 209 | 211 | 219 |
|---|---|---|---|---|---|---|---|---|---|---|---|---|---|---|---|---|
| MaizeHPPD | N | S | H | L | G | A | F | A | A | D | R | E | G | A | Y | I |
| Diversity | R | A | GVQSCI | V | A | V | L | S | P | V | G | G | D | V | C | VLM |

| Position | 221 | 225 | 233 | 253 | 260 | 261 | 262 | 278 | 282 | 301 | 316 | 320 | 327 | 328 | 331 | 341 |
|---|---|---|---|---|---|---|---|---|---|---|---|---|---|---|---|---|
| MaizeHPPD | G | E | F | A | M | V | L | H | R | M | Q | A | M | A | T | R |
| Diversity | VASC | D | VCLMI | T | LI | A | WI | R | K | I | RK | S | L | P | GQPLH | DEACI |

| Position | 352 | 360 | 382 | 383 | 395 | 405 | 414 | 417 | 440 |
|---|---|---|---|---|---|---|---|---|---|
| MaizeHPPD | K | L | T | L | E | K | G | S | A |
| Diversity | N | M | A | F | G | E | DTFVQASRMHYK | G | TK |

TABLE 24C

Diversity associated with improved Insensitivity Parameter (ON x OFF)

Insensitivity Parameter (OnxOff)

| Position | 32 | 40 | 42 | 44 | 46 | 47 | 68 | 71 | 98 | 114 | 120 | 122 | 125 | 137 | 144 | 146 |
|---|---|---|---|---|---|---|---|---|---|---|---|---|---|---|---|---|
| MaizeHPPD | N | S | R | H | L | A | G | A | F | A | A | A | R | V | A | D |
| Diversity | R | A | H | VGQSCLI | V | S | A | V | L | S | P | T | S | I | V | V |

| Position | 150 | 161 | 167 | 175 | 184 | 187 | 193 | 202 | 207 | 209 | 211 | 219 | 221 | 225 | 226 | 233 |
|---|---|---|---|---|---|---|---|---|---|---|---|---|---|---|---|---|
| MaizeHPPD | A | G | R | E | Y | Y | G | G | G | A | Y | I | G | E | L | F |
| Diversity | S | S | G | G | F | H | D | R | D | V | C | VLM | VASC | D | M | VCLMI |

| Position | 241 | 253 | 260 | 261 | 262 | 268 | 278 | 289 | 291 | 301 | 303 | 316 | 320 | 327 | 328 | 331 |
|---|---|---|---|---|---|---|---|---|---|---|---|---|---|---|---|---|
| MaizeHPPD | E | A | M | V | L | N | H | F | D | M | L | Q | A | M | A | T |
| Diversity | G | T | VLI | A | WI | G | R | Y | E | I | V | RK | S | L | P | GQPLH |

TABLE 24C-continued

Diversity associated with improved Insensitivity Parameter (ON x OFF)

```
Position    341 347 352  360  377 383 387 395 405  414      417 437 440 442 443 444
MaizeHPPD   R   T   K    L    V   L   I   E   K    G        S   A   A   Q   G   S
Diversity   DEACI S DEN  M    LI  F   M   G   E    DTFVQAS  G   P   TVK A   Q   G
                                                   RMHYK
```

TABLE 24D

Diversity associated with improved Vmax MT

Vmax MT

```
Position    40  44     46  68  71  98  120  167  175 225 233   253 261 301 316 320
MaizeHPPD   S   H      L   G   A   F   A    R    E   E   F     A   V   M   Q   A
Diversity   A   GVQSC  V   A   V   L   P    G    G   D   VCLMI T   A   I   RK  S Position    327 328  331    341   352 360 383  414     417 440
MaizeHPPD   M   A    T      R     K   L   L    G       S   A
Diversity   L   P    GQPLH  DEAC  N   M   F    DTFVQA  G   TK
                                                 RMHK
```

TABLE 24E

Diversity associated with improved ON x OFF x $k_{cat}$

On x Off x kcat

```
Position    32  40  44      46  68  71  98  114 120  167  175  209  219  221  225  233
MaizeHPPD   N   S   H       L   G   A   F   A   A    R    E    A    I    G    E    F
Diversity   R   A   GVQSCI  V   A   V   L   S   P    G    G    V    VL   A    D    VCLMI Position    253 261  289  301 303 316 320 327 328  331    341   352 360 383  414      417
MaizeHPPD   A   V    F    M   L   Q   A   M   A    T      R     K   L   L    G        S
Diversity   T   A    Y    I   V   RK  S   L   P    GQPLH  DEACI N   M   F    DTFVQA   G
                                                                               SRMHYK Position    440
MaizeHPPD   A
Diversity   TK
```

TABLE 25

| Seq or DNA template ID | kcat, min$^{-1}$ | Km, uM | kcat/Km min$^{-1}$uM$^{-1}$ | ON rate ratio | OFF rate ratio | Insensitivity Parameter (ON x OFF) | Vmax MT min$^{-1}$ | OFF time sec | Ratio of Insensitivity Parameter | ON x OFF x kcat min$^{-1}$ |
|---|---|---|---|---|---|---|---|---|---|---|
| 1_MaizeWildType | 242 | 5.61 | 44.0 | 0.193 | 0.230 | 0.0444 | 85.3 | 310 | 1.00 | 10.7 |
| D0223970 | 123 | 5.45 | 22.7 | 0.641 | 0.419 | 0.269 | 91.0 | 130 | 6.05 | 33.2 |
| D0223972 | 79.3 | 2.74 | 29.0 | 0.684 | 0.763 | 0.522 | 112.2 | 150 | 11.75 | 41.4 |
| D0223973 | 133 | 4.51 | 29.8 | 0.584 | 0.415 | 0.243 | 92.0 | 200 | 5.47 | 32.3 |
| D0223974 | 134 | 7.29 | 18.3 | 0.724 | 0.404 | 0.293 | 86.9 | 200 | 6.59 | 39.1 |
| D0223975 | 106 | 3.61 | 29.4 | 0.644 | 0.502 | 0.324 | 81.3 | 180 | 7.29 | 34.3 |
| D0226305 | 122 | 5.33 | 26.2 | 0.629 | 0.611 | 0.384 | 97.2 | 170 | 8.64 | 47.0 |
| D0226660 | 114 | 3.96 | 28.9 | 0.676 | 0.685 | 0.463 | 129.6 | 80 | 10.43 | 52.7 |
| D0227054 | 135 | 4.72 | 29.2 | 0.714 | 0.587 | 0.419 | 81.9 | 190 | 9.45 | 56.8 |
| D0226899 | 136 | 4.85 | 27.8 | 0.692 | 0.555 | 0.384 | 82.7 | 260 | 8.65 | 52.0 |
| D0227043 | 139 | 6.78 | 20.5 | 0.604 | 0.584 | 0.352 | 111.6 | 130 | 7.94 | 49.0 |

The article "a" and "an" are used herein to refer to one or more than one (i.e., to at least one) of the grammatical object of the article. By way of example, "an element" means one or more element.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (490 sequences)

SEQ ID NO: 1 - protein, 444 aa, Zea mays
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 2 - protein, 449 aa, Glycine max
MAIPMCNEIQAQAQAQAQAQPGFKLVGFKNFVRTNPKSDRFQVNRFHHIEFWCTDATNASRRFSWGLGMPIVAKSDLSTGNQIHASYLLRSGDLSFLFSAPYSPSLSAGSSAASSASIPSFDAATCLAFAAKHGFGVRAIALEVADAEAAFSASVAKGAEPASPPVLVDDRTGFAEVRLYGDVVLRYVSYKDAAPQAPHADPSRWFLPGFEAAASSSSFPELDYGIRRLDHAVGNVPELAPAVRYLKGFSGFHEFAEFTAEDVGTSESGLNSVVLANNSETVLLPLNEPVYGTKRKSQIETYLEHNEGAGVQHLALVTHDIFTTLREMRKRSFLGGFEFMPSPPPTYYANLHNRAADVLTVDQIKQCEELGILVDRDDQGTLLQIFTKPVGDRPTIFIEIIQRIGCMVEDEEGKVYQKGACGGFGKGNFSELFKSIEEYEKTLEAKRTA

SEQ ID NO: 3 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 4 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRIAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 5 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 6 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 7 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 8 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 9 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVGLYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 10 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKDNFSQLFKSIEDYEKSLEAKQAAAAATAQGS

SEQ ID NO: 11 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMQARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 12 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHMALASDDVLRTLREMQARSAMGGFEFLPPRPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 13 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSVVLANNSENVLLPLNEPVHGTKRRSQIQTYLDHHGGPGVQHIAVASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 14 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSVVLANNSENVLLPLNEPVHGTKRRSQIQTFLDHHGGPGVQHIAVASDDVLRTLREMQARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 15 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 16 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSVVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 17 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTTESGLNSVVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 18 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 19 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSVVLANNSENVLLPLNEPVHGTKRRSQIQTFLDHHGGPGVQHIALASDDVLRTLREMRARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 20 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSVVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 21 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 22 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSVVLANNSENVLLPLNEPVHGTKRRSQIQTFLDHHGGPGVQHIAVASDDVLRTLREMQARSAMGGFEFLPPPPSDYYDGVRRRAGDVLSEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 23 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMQARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 24 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMQARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGSLT

SEQ ID NO: 25 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAEATAQGSLT

SEQ ID NO: 26 - protein, 446 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLSEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 27 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 28 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIAVASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 29 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFMPPPPSDYYDGVRRRAGDVLTEAQINECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 30 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPDAVDYGLSRFDHIVGNVPELAPAAAYFAGFTGFHEFAEFTTEDVGTTESGLNSVVLANNSENVLLPLNEPVHGTKRRSQIQTFLDHHGGPGVQHIAVASDDVLRTLREMQARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 31 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 32 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMRARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGSLT

SEQ ID NO: 33 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 34 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSVVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGSLT

SEQ ID NO: 35 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 36 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 37 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRSSVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 38 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLSEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 39 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 40 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 41 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 42 - protein, 446 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 43 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSVVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 44 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHGFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 45 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 46 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTTESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 47 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 48 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSVVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 49 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 50 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSVVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 51 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 52 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 53 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 54 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 55 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 56 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 57 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 58 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 59 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 60 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSVVLANNSENVLLPLNEPVHGTKRRSQIQTYLDHHGGPGVQHIAVASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 61 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 62 - protein, 446 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSVVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 63 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 64 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 65 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 66 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 67 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 68 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 69 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 70 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 71 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 72 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 73 - protein, 446 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 74 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 75 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 76 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHVVGNVPELAPAAAYLAGFTGFHEFAEFTTEDVGTAESGLNSMVLANNSENVLLPLNEPVHGTKRRSQIQTYLDHHGGPGVQHIALASDDVLRTLREMRARSAMGGFEFMPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 77 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 78 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSVVLANNSENVLLPLNEPVHGTKRRSQIQTFLDHHGGPGVQHIALASDDVLRTLREMQARSAMGGFEFMPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 79 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 80 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 81 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMKARSAMGGFEFLPPPPSDYYDGVRRRAGDVLTEAQIKECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 82 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 83 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 84 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 85 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 86 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 87 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSVVLANNSEGVLLPLNEPVHGTKRRSQIQTFLEHHGGPGVQHIALASDDVLRTLREMRARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSELFKSIEDYEKSLEAKQAAPAATAQGS

SEQ ID NO: 88 - protein, 444 aa, Artificial Sequence
  HPPD variant
MGPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAIALRVADAEDAFRASVAAGARPAFGPVDLGRGFRLAEVELYGDVVLRYVSYPDGAAGEPFLPGFEGVASPGAVDYGLSRFDHVVGNVPEMAPAAAYLAGFTGFHEFAEFTTEDVGTTESGLNSVVLANNSEGVLLPLNEPVHGTKRRSQIQTFLDHHGGPGVQHIALASDDVLRTLREMRARSAMGGFEFMPPPPSDYYDGVRRRAGDVLTEAQIEECQELGVLVDRDDQGVLLQIFTKPIGDRPTLFLEMIQRIGCMEKDEKGQEYQKGGCGGFGKGNFSQLFKSIEDYEKSLEAKQAAAAATAQGS

SEQ ID NO: 89 - protein, 444 aa, Artificial Sequence
  HPPD variant
MGPTPTATAAGAAVAAASAAEQAAFRLVGHRNFVRFNPRSDHFHTLAFHHVELWCADAASAAGRFSFGLGAPLAARSDLSTGNSAHASLLLRSGSLSFLFTAPYAHGADAATASLPSFSAAAARRFAADHGLAVRAIALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTTESGLNSVVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAPAATAQGS

SEQ ID NO: 90 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARSFAADHGLAVRAIALRVADAEDAFRASVAAGARPAFGPVDLGRGFRLAEVELYGDVVLRYVSYPDGAAGEPFLPGFEGVASPGAVDYGLSRFDHVVGNVPEMAPAAAYLAGFTGFHEFAEFTTEDVGTTESGLNSVVLANNSENVLLPLNEPVHGTKRRSQIQTFLDHHGGPGVQHIALASDDVLRTLREMRARSAMGGFEFMPPPPSDYYDGVRRRAGDVLTEAQINECQELGVLVDRDDQGVLLQIFTKPIGDRPTLFLEMIQRIGCMEKDEKGQEYQKGGCGGFGKGNFSQLFKSIEDYEKSLEAKQAAPAATAQGS

SEQ ID NO: 91 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAIALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSVVLANNSENVLLPLNEPVHGTKRRSQIQTFLEHHGGPGVQHIALASDDVLRTLREMRARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSELFKSIEEYEKSLEAKQAAPAATAQGS

SEQ ID NO: 92 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 93 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 94 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 95 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 96 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLSEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 97 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLSEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 98 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 99 - protein, 444 aa, Artificial Sequence
  HPPD variant
MGPTPTAAAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLSEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 100 - protein, 446 aa, Artificial Sequence
  HPPD variant
MGPTPTAAAAGAAVAAASAAEQAAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 101 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFERVASPGAVDYGLSRFDHVVGNVPEMAPAAAYLAGFTGFHEFAEFTTEDVGTTESGLNSVVLANNSENVLLPLNEPVHGTKRRSQIQTFLEHHGGPGVQHIALASDDVLRTLREMRARSAMGGFEFMPPPPSDYYDGVRRRAGDVLSEAQIDECQELGVLVDRDDQGVLLQIFTKPIGDRPTLFLEMIQRIGCMEKDEKGQEYQKGGCGGFGKGNFSQLFKSIEDYEKSLEAKQAAAAATAQGS

SEQ ID NO: 102 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSHPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 103 - protein, 444 aa, Artificial Sequence
  HPPD variant
MGPTPTATAAGAAVAAASAAEQAAFRLVGLRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRGSVAAGARPAFGPVDLGRGFRLAEVELYGDVVLRYVSYPDGAAGEPFLPGFEGVASPGAADYGLSRFDHVVCNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 104 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHLVVNVPELAPAAAYFAGFTGFHEFAEFTTEDVGTAESGLNSIVWANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 105 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGMAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSLVWANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 106 - protein, 444 aa, Artificial Sequence
  HPPD variant
MGPTPTATAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHMVSNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 107 - protein, 437 aa, Artificial Sequence
  HPPD variant
MGPTPTATAASAAEQAAFRLVGHRRFVRFNPRSDRFLTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVSNVPELAPAAAYFAGFTGFHEFAEFTTEDVGTTESGLNSLVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 108 - protein, 444 aa, Artificial Sequence
  HPPD variant
MGPTPTATAAGAAVAAASAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHLVANVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 109 - protein, 437 aa, Artificial Sequence
  HPPD variant
MGPTPTATAAGAAEQAAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVSNVPELAPAAAYFAGFTGFHEFAEFTTEDVGTTESGLNSIVWANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 110 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVVNVPELAPAAAYFAGFTGFHEFAEFTTEDVGTAESGLNSMVIANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 111 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVCNVPELAPAAAYFAGFTGFHEFAEFTTEDVGTAESGLNSIVWANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 112 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVVNVPELAPAAAYFAGFTGFHEFAEFTTEDVGTAESGLNSLVIANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 113 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 114 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHMALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 115 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 116 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 117 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 118 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 119 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 120 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 121 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 122 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 123 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 124 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 125 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 126 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 127 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 128 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 129 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 130 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 131 - protein, 444 aa, Artificial Sequence
  HPPD variant
MGPTPTATAAGAAVAAASAAEQAAFRLVGHRNFVRFNPRSDRFHTLSFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 132 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 133 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 134 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 135 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 136 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 137 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 138 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 139 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 140 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMPPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 141 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 142 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 143 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAPAATAQGS

SEQ ID NO: 144 - protein, 445 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAATARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAAVAAQGS

SEQ ID NO: 145 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAAAAQGS

SEQ ID NO: 146 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 147 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 148 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAATAQGS

SEQ ID NO: 149 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADVEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 150 - protein, 437 aa, Artificial Sequence
  HPPD variant
MGPTPTATAAGAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 151 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAPAATAQGS

SEQ ID NO: 152 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAATAQGS

SEQ ID NO: 153 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 154 - protein, 446 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPDAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 155 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 156 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 157 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKDNFSQLFKSIEDYEKSLEAKQAAAAAAAQGS

SEQ ID NO: 158 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEVAFRASVAAGARPAFGPVDLGRGFRLAEVGLYGDVVLRYVSYPDGAAGEPFLPGFEGVASPGAADCGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRCAGDVLTEAQIKECQELGVLVDRDDQGVLLQIFTKPVGDRPTLFLEIIQRIGCMGKDEKGQEYQEGGCGGFGKGNFSQLFKSIEDYEKSLEAKQAAAAAAAQGS

SEQ ID NO: 159 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 160 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 161 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 162 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVRGTKRRSQIQTFLDHHGGPGVQHMALASDDVLRTLREMQARSAMGGFEFMAPPTSDYYDGVRRRAGDVLTEAQIKECQELGVMVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 163 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKKRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPALFLEIIQRIGCMEKDEKGQEYQKGGCGGFGKGNFSQLFKSIEDYEKSLEAKQAAAAAAAQGS

SEQ ID NO: 164 - protein, 444 aa, Artificial Sequence
  HPPD variant
MGPTPAATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVGLYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 165 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 166 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRIAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 167 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 168 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 169 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 170 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 171 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVGLYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 172 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKDNFSQLFKSIEDYEKSLEAKQAAAAATAQGS

SEQ ID NO: 173 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMQARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 174 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHMALASDDVLRTLREMQARSAMGGFEFLPPRPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 175 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSVVLANNSENVLLPLNEPVHGTKRRSQIQTYLDHHGGPGVQHIAVASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 176 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSVVLANNSENVLLPLNEPVHGTKRRSQIQTFLDHHGGPGVQHIAVASDDVLRTLREMQARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 177 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 178 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSVVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 179 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTTESGLNSVVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 180 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 181 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSVVLANNSENVLLPLNEPVHGTKRRSQIQTFLDHHGGPGVQHIALASDDVLRTLREMRARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 182 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSVVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 183 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 184 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSVVLANNSENVLLPLNEPVHGTKRRSQIQTFLDHHGGPGVQHIAVASDDVLRTLREMQARSAMGGFEFLPPPPSDYYDGVRRRAGDVLSEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 185 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMQARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 186 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMQARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGSLT

SEQ ID NO: 187 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAEATAQGSLT

SEQ ID NO: 188 - protein, 424 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLSEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 189 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPLGDRPTLFLEMIQRIGCMEKDEKGQEYQKGGCGGFGKGNFSQLFKSIEDYEKSLEAKQAAAAATAQGS

SEQ ID NO: 190 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIAVASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 191 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFMPPPPSDYYDGVRRRAGDVLTEAQINECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 192 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPDAVDYGLSRFDHIVGNVPELAPAAAYFAGFTGFHEFAEFTTEDVGTTESGLNSVVLANNSENVLLPLNEPVHGTKRRSQIQTFLDHHGGPGVQHIAVASDDVLRTLREMQARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 193 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 194 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIAVASDDVLRTLREMRARSAMGGFEFLPPPPSDYYDGVRRRAGDVLTEAQINECQELGVLVDRDDQGVLLQIFTKPLGDRPTLFLEMIQRIGCMEKDEKGQEYQKGGCGGFGKGNFSQLFKSIEDYEKSLEAKQAAAAATAQGSLT

SEQ ID NO: 195 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 196 - protein, 424 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSVVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGSLT

SEQ ID NO: 197 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 198 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 199 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRSSVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 200 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLSEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 201 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 202 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 203 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 204 - protein, 424 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 205 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSVVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 206 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHGFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 207 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 208 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTTESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 209 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 210 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSVVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 211 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 212 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSVVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 213 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 214 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 215 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 216 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 217 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 218 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 219 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 220 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 221 - protein, 424 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 222 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSVVLANNSENVLLPLNEPVHGTKRRSQIQTYLDHHGGPGVQHIAVASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 223 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 224 - protein, 424 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSVVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 225 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 226 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 227 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 228 - protein, 424 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 229 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 230 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 231 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 232 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 233 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 234 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 235 - protein, 424 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGSLT

SEQ ID NO: 236 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 237 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 238 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHVVGNVPELAPAAAYLAGFTGFHEFAEFTTEDVGTAESGLNSMVLANNSENVLLPLNEPVHGTKRRSQIQTYLDHHGGPGVQHIALASDDVLRTLREMRARSAMGGFEFMPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 239 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 240 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYLAGFTGFHEFAEFTTEDVGTTESGLNSVVLANNSENVLLPLNEPVHGTKRRSQIQTFLDHHGGPGVQHIALASDDVLRTLREMQARSAMGGFEFMPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 241 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 242 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 243 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTYLDHHGGPGVQHIALASDDVLRTLREMKARSAMGGFEFLPPPPSDYYDGVRRRAGDVLTEAQIKECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 244 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 245 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 246 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 247 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 248 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 249 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSVVLANNSEGVLLPLNEPVHGTKRRSQIQTFLEHHGGPGVQHIALASDDVLRTLREMRARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSELFKSIEDYEKSLEAKQAAPAATAQGS

SEQ ID NO: 250 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAIALRVADAEDAFRASVAAGARPAFGPVDLGRGFRLAEVELYGDVVLRYVSYPDGAAGEPFLPGFEGVASPGAVDYGLSRFDHVVGNVPEMAPAAAYLAGFTGFHEFAEFTTEDVGTTESGLNSVVLANNSEGVLLPLNEPVHGTKRRSQIQTFLDHHGGPGVQHIALASDDVLRTLREMRARSAMGGFEFMPPPPSDYYDGVRRRAGDVLTEAQIEECQELGVLVDRDDQGVLLQIFTKPIGDRPTLFLEMIQRIGCMEKDEKGQEYQKGGCGGFGKGNFSQLFKSIEDYEKSLEAKQAAAAATAQGS

SEQ ID NO: 251 - protein, 422 aa, Artificial Sequence
  HPPD variant
MAFRLVGHRNFVRFNPRSDHFHTLAFHHVELWCADAASAAGRFSFGLGAPLAARSDLSTGNSAHASLLLRSGSLSFLFTAPYAHGADAATASLPSFSAAAARRFAADHGLAVRAIALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTTESGLNSVVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAPAATAQGS

SEQ ID NO: 252 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARSFAADHGLAVRAIALRVADAEDAFRASVAAGARPAFGPVDLGRGFRLAEVELYGDVVLRYVSYPDGAAGEPFLPGFEGVASPGAVDYGLSRFDHVVGNVPEMAPAAAYLAGFTGFHEFAEFTTEDVGTTESGLNSVVLANNSENVLLPLNEPVHGTKRRSQIQTFLDHHGGPGVQHIALASDDVLRTLREMRARSAMGGFEFMPPPPSDYYDGVRRRAGDVLTEAQINECQELGVLVDRDDQGVLLQIFTKPIGDRPTLFLEMIQRIGCMEKDEKGQEYQKGGCGGFGKGNFSQLFKSIEDYEKSLEAKQAAPAATAQGS

SEQ ID NO: 253 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAIALRVADAEDAFRASVAAGARPAFGPVDLGRGFRLAEVELYGDVVLRYVSYPDGAAGEPFLPGFEGVASPGAVDYGLSRFDHVVGNVPELAPAAAYLAGFTGFHEFAEFTTEDVGTTESGLNSVVLANNSENVLLPLNEPVHGTKRRSQIQTFLEHHGGPGVQHIALASDDVLRTLREMRARSAMGGFEFMPPPPSDYYDGVRRRAGDVLTEAQINECQELGVLVDRDDQGVLLQIFTKPVGDRPTLFLEMIQRIGCMEKDEKGQEYQKGGCGGFGKGNFSELFKSIEEYEKSLEAKQAAPAATAQGS

SEQ ID NO: 254 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 255 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIAVASDDVLRTLREMQARSAMGGFEFLPPPPSDYYDGVRRRAGDVLTEAQIKECQELGVLVDRDDQGVLLQIFTKPVGDRPTFFLEMIQRIGCMEKDEKGQEYQKGGCGGFGKGNFSQLFKSIEDYEKSLEAKQAAAAATAQGS

SEQ ID NO: 256 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 257 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 258 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFSPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLSEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 259 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLSEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 260 - protein, 422 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 261 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRFVSYPDGAADEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLSEAQINECQELGVLVDRDDQGVLLQIFTKPVGDRPTLFLEMIQRIGCMEKDEKGQEYQKGGCGGFGKGNFSQLFKSIEDYEKSLEAKQAAAAATAQGS

SEQ ID NO: 262 - protein, 424 aa, Artificial Sequence
  HPPD variant
MAFRLVGHRRFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAADEPFLPGFEGVASPGAADYGLSRFDHIVGNVPELAPAAAYFAGFTGFHEFAEFTTEDVGTTESGLNSMVLANNSENVLLPLNEPVHGTKRRSQIQTYLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 263 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFERVASPGAVDYGLSRFDHVVGNVPEMAPAAAYLAGFTGFHEFAEFTTEDVGTTESGLNSVVLANNSENVLLPLNEPVHGTKRRSQIQTFLEHHGGPGVQHIALASDDVLRTLREMRARSAMGGFEFMPPPPSDYYDGVRRRAGDVLSEAQIDECQELGVLVDRDDQGVLLQIFTKPIGDRPTLFLEMIQRIGCMEKDEKGQEYQKGGCGGFGKGNFSQLFKSIEDYEKSLEAKQAAAAATAQGS

SEQ ID NO: 264 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSHPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 265 - protein, 422 aa, Artificial Sequence
  HPPD variant
MAFRLVGLRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRGSVAAGARPAFGPVDLGRGFRLAEVELYGDVVLRYVSYPDGAAGEPFLPGFEGVASPGAADYGLSRFDHVVCNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 266 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHLVVNVPELAPAAAYFAGFTGFHEFAEFTTEDVGTAESGLNSIVWANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 267 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGMAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSLVWANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 268 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHMVSNVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 269 - protein, 422 aa, Artificial Sequence
  HPPD variant
MAFRLVGHRRFVRFNPRSDRFLTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVSNVPELAPAAAYFAGFTGFHEFAEFTTEDVGTTESGLNSLVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 270 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHLVANVPELAPAAAYFAGFTGFHEFAEFTTEDVGTTESGLNSMVLANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 271 - protein, 422 aa, Artificial Sequence
  HPPD variant
MAFRLVGHRRFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVSNVPELAPAAAYFAGFTGFHEFAEFTTEDVGTTESGLNSIVWANNSENVLLPLNEPVHGTKRRSQIQTFLDHHGGPGVQHIALASDDVLRTLREMQARSAMGGFEFMPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 272 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVVNVPELAPAAAYFAGFTGFHEFAEFTTEDVGTAESGLNSMVIANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 273 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVCNVPELAPAAAYFAGFTGFHEFAEFTTEDVGTAESGLNSIVWANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 274 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVVNVPELAPAAAYFAGFTGFHEFAEFTTEDVGTAESGLNSLVIANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 275 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 276 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHMALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 277 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 278 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 279 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 280 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 281 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 282 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 283 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 284 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 285 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 286 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 287 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 288 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 289 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 290 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 291 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAAAAQGS

SEQ ID NO: 292 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 293 - protein, 422 aa, Artificial Sequence
  HPPD variant
MAFRLVGHRNFVRFNPRSDRFHTLSFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 294 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 295 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 296 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 297 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 298 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 299 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 300 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 301 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 302 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMPPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 303 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 304 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 305 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAPAATAQGS

SEQ ID NO: 306 - protein, 423 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAATARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAAVAAQGS

SEQ ID NO: 307 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAAAAQGS

SEQ ID NO: 308 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 309 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 310 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAATAQGS

SEQ ID NO: 311 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADVEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 312 - protein, 422 aa, Artificial Sequence; identical to SEQ ID NO: 304
  HPPD variant

SEQ ID NO: 313 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEMIQRIGCMEKDEKGQEYQKGGCGGFGKGNFSQLFKSIEDYEKSLEAKQAAPAATAQGS

SEQ ID NO: 314 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAVDYGLSRFDHVVGNVPELAPAAAYFAGFTGFHEFAEFTTEDVGTAESGLNSMVLANNSENVLLPLNEPVHGTKRRSQIQTYLDHHGGPGVQHIALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAPAATAQGS

SEQ ID NO: 315 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 316 - protein, 424 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPDAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAATAQGSLT

SEQ ID NO: 317 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTFLDHHGGPGVQHIALASDDVLRTLREMRARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 318 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATASLPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTTESGLNSMVLANNSENVLLPLNEPVHGTKRRSQIQTFLDHHGGPGVQHMALASDDVLRTLREMQARSAMGGFEFLPPPPSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 319 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKDNFSQLFKSIEDYEKSLEAKQAAAAAAAQGS

SEQ ID NO: 320 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEVAFRASVAAGARPAFGPVDLGRGFRLAEVGLYGDVVLRYVSYPDGAAGEPFLPGFEGVASPGAADCGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRCAGDVLTEAQIKECQELGVLVDRDDQGVLLQIFTKPVGDRPTLFLEIIQRIGCMGKDEKGQEYQEGGCGGFGKGNFSQLFKSIEDYEKSLEAKQAAAAAAAQGS

SEQ ID NO: 321 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHIALASDDVLRTLREMQARSAMGGFEFMAPPTSDYYDGVRRRAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 322 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQINECQELGVLVDRDDQGVLLQIFTKPVGDRPTLFLEIIQRIGCMEKDEKGQEYQKGGCGGFGKGNFSQLFKSIEDYEKSLEAKQAAAAATAQGS

SEQ ID NO: 323 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHVVGNVPELAPAAAYFAGFTGFHEFAEFTTEDVGTAESGLNSMVLANNSENVLLPLNEPVHGTKRRSQIQTFLDHHGGPGVQHIALASDDVLRTLREMRARSAMGGFEFMAPPTSDYYDGVRRRAGDVLTEAQIKECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 324 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVRGTKRRSQIQTFLDHHGGPGVQHMALASDDVLRTLREMQARSAMGGFEFMAPPTSDYYDGVRRRAGDVLTEAQIKECQELGVMVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 325 - protein, 422 aa, Artificial Sequence
  HPPD variant
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKKRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPALFLEIIQRIGCMEKDEKGQEYQKGGCGGFGKGNFSQLFKSIEDYEKSLEAKQAAAAAAAQGS

SEQ ID NO: 326 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVGLYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVLVDRDDQGVLLQIFTKPVGDRPTFFLEIIQRIGCMEKDEKGQEYQKGGCGGFGKGNFSQLFKSIEDYEKSLEAKQAAAAATAQGS

SEQ ID NO: 327 - protein, 422 aa, Zea mays
MAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 328 - protein, 434 aa, Hordeum vulgare
MPPTPTTPAATGAAAAVTPEHARPHRMVRFNPRSDRFHTLSFHHVEFWCADAASAAGRFAFALGAPLAARSDLSTGNSAHASQLLRSGSLAFLFTAPYANGCDAATASLPSFSADAARRFSADHGIAVRSVALRVADAAEAFRASRRRGARPAFAPVDLGRGFAFAEVELYGDVVLRFVSHPDGTDVPFLPGFEGVTNPDAVDYGLTRFDHVVGNVPELAPAAAYIAGFTGFHEFAEFTAEDVGTTESGLNSVVLANNSEGVLLPLNEPVHGTKRRSQIQTFLEHHGGPGVQHIAVASSDVLRTLRKMRARSAMGGFDFLPPPLPKYYEGVRRLAGDVLSEAQIKECQELGVLVDRDDQGVLLQIFTKPVGDRPTLFLEMIQRIGCMEKDERGEEYQKGGCGGFGKGNFSELFKSIEDYEKSLEAKQSAAVQGS

SEQ ID NO: 329 - protein, 440 aa, Avena sativa
MPPTPATATGAAAAAVTPEHAARSFPRVVRVNPRSDRFPVLSFHHVELWCADAASAAGRFSFALGAPLAARSDLSTGNSAHASLLLRSGALAFLFTAPYAPPPQEAATAAATASIPSFSADAARTFAAAHGLAVRSVGVRVADAAEAFRVSVAGGARPAFAPADLGHGFGLAEVELYGDVVLRFVSYPDETDLPFLPGFERVSSPGAVDYGLTRFDHVVGNVPEMAPVIDYMKGFLGFHEFAEFTAEDVGTTESGLNSVVLANNSEAVLLPLNEPVHGTKRRSQIQTYLEYHGGPGVQHIALASNDVLRTLREMRARTPMGGFEFMAPPQAKYYEGVRRIAGDVLSEEQIKECQELGVLVDRDDQGVLLQIFTKPVGDRPTFFLEMIQRIGCMEKDEVGQEYQKGGCGGFGKGNFSELFKSIEDYEKSLEVKQSVVAQKS

SEQ ID NO: 330 - protein, 446 aa, Oryza sativa
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASVAAGARPAFQPADLGGGFGLAEVELYGDVVLRFVSHPDGADAPFLPGFEGVSNPGAVDYGLRRFDHVVGNVPELAPVAAYISGFTGFHEFAEFTAEDVGTAESGLNSVVLANNAETVLLPLNEPVHGTKRRSQIQTYLDHHGGPGVQHIALASDDVLGTLREMRARSAMGGFEFLAPPPPNYYDGVRRRAGDVLSEEQINECQELGVLVDRDDQGVLLQIFTKPVGDRPTFFLEMIQRIGCMEKDESGQEYQKGGCGGFGKGNFSELFKSIEEYEKSLEAKQAPTVQGS

SEQ ID NO: 331 - protein, 436 aa, Triticum aestivum
MPPTPTTPAATGAGAAAAVTPEHARPRRMVRFNPRSDRFHTLSFHHVEFWCADAASAAGRFAFALGAPLAARSDLSTGNSVHASQLLRSGNLAFLFTAPYANGCDAATASLPSFSADAARRFSADHGLAVRSIALRVADAAEAFRASVDGGARPAFSPVDLGRGFGFAEVELYGDVVLRFVSHPDDTDVPFLPGFEGVSNPDAVDYGLTRFDHVVGNVPELAPAAAYVAGFAGFHEFAEFTTEDVGTAESGLNSMVLANNSEGVLLPLNEPVHGTKRRSQIQTFLEHHGGSGVQHIAVASSDVLRTLREMRARSAMGGFDFLPPRCRKYYEGVRRIAGDVLSEAQIKECQELGVLVDRDDQGVLLQIFTKPVGDRPTLFLEMIQRIGCMEKDERGEEYQKGGCGGFGKGNFSELFKSIEDYEKSLEAKQSAAVQGS

SEQ ID NO: 332 - protein, 442 aa, Daucus carota
MGKKQSEAEILSSNSSNTSPATFKLVGFNNFVRANPKSDHFAVKRFHHIEFWCGDATNTSRRFSWGLGMPLVAKSDLSTGNSVHASYLVRSANLSFVFTAPYSPSTTTSSGSAAIPSFSASGFHSFAAKHGLAVRAIALEVADVAAAFEASVARGARPASAPVELDDQAWLAEVELYGDVVLRFVSFGREEGLFLPGFEAVEGTASFPDLDYGIRRLDHAVGNVTELGPVVEYIKGFTGFHEFAEFTAEDVGTLESGLNSVVLANNEEMVLLPLNEPVYGTKRKSQIQTYLEHNEGAGVQHLALVSEDIFRTLREMRKRSCLGGFEFMPSPPPTYYKNLKNRVGDVLSDEQIKECEDLGILVDRDDQGTLLQIFTKPVGDRPTLFIEIIQRVGCMLKDDAGQMYQKGGCGGFGKGNFSELFKSIEEYEKTLEAKQITGSAAA

SEQ ID NO: 333 - protein, 436 aa, Solenosteman sautellarioides
MGQESTAAAAVVPAEFKLVGHKNFVRSNPMSDHFPVHRFHHVEFWCGDATNTSRRFSWGLGMPLVAKSDLSTGNSAHASYLLRSGELSFVFTAPYSPSLAEPSSASIPTFSFSDHRAFTSSHGLAVRAVAIQVDSASSAYSAAVSRGAKPVSPPVVLADCETAIAEVHLYGDTVLRFVSCGSGADGWFLPGFEVVGDGVSCQELDYGIRRLDHAVGNVPKLEPVVDYLKKFTGFHEFAEFTAEDVGTAESGLNSVVLANNNENVLFPLNEPVYGTKRKSQIQTYLDHNEGAGVQHLALITEDIFRTLREMRKRSEVGGFEFMPSPPPTYYRNLKSRAGDVLSDEQIEECEKLGILIDRDDQGTLLQIFTKPVGDRPTLFIEIIQRVGCMMKDEEGKMYQKGGCGGFGKGNFSELFKSIEEYEKMLESKLVTKTAMA

SEQ ID NO: 334 - protein, 263 aa, Picea Sitchensis
MSEVKLYGDVVLRFVSKDGFEGPFLPNYEPVQSIPLSYGIIRVDHAVGNVEKLEEAVEYVAKFTGFHRFAEFTAEDVGTAESGLNSMVLASNNEMVLLPMNEPVFGTKRKSQIQTYLEHNEGPGLQHLALICSDIFSTLKEMRMRSDIGGFEFMPKPPPTYYKNLRNRVADILTEKQMEECDELGILVDRDDQGVLLQIFTKPIGDRPTIFIEIIQRVGCLLTDENGQAYQKGGCGGFGKGNFSELFKSIEEYEKTLEGRVQS

SEQ ID NO: 335 - protein, 363 aa, Abution theophrasti
CTDATNAACRFSWGLGMQFVAKSDLSTGNLSHASYLLRSDHLSLLFTAPYSPSIALSQNISPHSTASIPSFDHTLCRSFSSSHGLVVRAIALEVEDSETAFATSISNGALPSSPPILLDGATISEVKLYGDVVLRYVSYSKNTNPHHFLPGFEKVEDNLSYPLDYGIRRLDHAVCCVPELGPAISYVKSFTGFHDLAEFTAEDVGTSESGLNSVILANNNEMVLMPIAEPVYGTKRKSQVQTYLEHNEGAGVQHLALLSEDIFRTLREMRKRSFVGGFEFMPSPPPTYYEKLKQRVGDILSDEQIKECEELGIMVDRDDQGTLLQIFTKPIGDRPTILLEIIQRIGCMVKDEEGKQYQKGGCG

SEQ ID NO: 336 - protein, 473 aa, Arabidopsis thaliana
MCLSLASTAQRNTKFRSRVLVLAELVKSMGHQNAAVSENQNHDDGAASSPGFKLVGFSKFVRKNPKSDKFKVKRFHHIEFWCGDATNVARRFSWGLGMRFSAKSDLSTGNMVHASYLLTSGDLRFLFTAPYSPSLSAGEIKPTTTASIPSFDHGSCRSFFSSHGLGVRAVAIEVEDAESAFSISVANGAIPSSPPIVLNEAVTIAEVKLYGDVVLRYVSYKAEDTEKSEFLPGFERVEDASSFPLDYGIRRLDHAVGNVPELGPALTYVAGFTGFHQFAEFTANDVGTAESGLNSAVLASNDEMVLLPINEPVHGTKRKSQIQTYLEHNEGAGLQHLALMSEDIFRTLREMRKRSSIGGFDFMPSPPPTYYQNLKKRVGDVLSDDQIKECEELGILVDRDDQGTLLQIFTKPLGDRPTIFIEIIQRVGCMMKDEEGKAYQSGGCGGFGKGNFSELFKSIEEYEKTLEAKQLVG

SEQ ID NO: 337 - protein, 443 aa, Brassica rapa
MGHENAAVSENQHHDDAATTSASPGFKLVGFSKFVRKNPKSDKFKVKRFHHIEFWCGDATNVARRFSWGLGMRFSAKSDLSTGNMVHASYLLTSGDLRFLFTAPYSPSLSAGENPPTTTASIPSFDHVTYRSFFSSHGLGVRAVAVEVEDAEAAFSISVSNGAVPSSPPIVLNDAVTIAEVKLYGDVVLRYVSYKVATVFLPRFETVDDTSSFPLDYGIRRLDHAVGNVPELGPALTYLSRLTGFHQFAEFTADDVGTAESGLNSAVLANNDETVLLPVNEPVHGTKRKSQIQTYLEHNEGAGVQHLALMSEDIFRTLREMRKRSGVGGFDFMPSPPPTYYKNLKNRVGDVLSEEQIEECEELGILVDRDDQGTLLQIFTKPLGDRPTIFIEIIQRIGCMKKDEEGRVYQSGGCGGFGKGNFSELFKSIEEYEKTLEAKQLVG

SEQ ID NO: 338 - protein, 430 aa, Coptis japonica
MVPSTASNLKLVGHTNFVHNNPKSDKFHVKKFHHIEFWSTDATNTARRFSWGLGMPMVAKSDLSTGNMVHASYLLRSGELNFLFTAPYSPSIAGNTLTHTASIPTYSHNLARLFASTHGLAVRAIAIEVQDAELAYNISVANGAKPSSSPIKLDEGVVLSEIQLYGDVVLRYLSFKNTNQSCPFLPGFEEVGEVSSSRGLDFGIRRLDHAVGNVPNLAEAIGYLKEFTGFHEFAEFTAEDVGTTESGLNSIVLASNDEMVLLPMNEPVYGTKRKSQIQTYLEHNEGAGVQHLALVSEDIFTTLREMRRRSGVGGFEFMPSPPPTYYKNLKNRAGDVLSDEQIKECEELGILVDRDAQGTLLQIFTKPVGDRPTIFVEIIQRLGCMLKDEEGKTYQKAGCGGFGKGNFSELFKSIEEYEKTLEAKANVVAA

SEQ ID NO: 339 - protein, 445 aa, Vitis vinifera
MGKQNTTTNNPAPGFKLVGFSNFLRTNPMSDRFGVKRFHHIEFWSTDATNLARRFSWGLGMPIVAKSDLSTGNVIHASYLTRSGDLNFLFTAPYSPSIAGDLENAAATASIPSFDHSACHAFAASHGLGVRAIAIEVDDAEGAFHTSVAHGARPMSPPVTMGGSVVISEVHLYGDAVLRYVSYKNPNPNATSDPSSWFLPGFEAVDEGSSFPVDFGLRRVDHTVGNVPKLAPVVTYLKQFTGFHEFAEFTAEDVGTSESGLNSVVLASNNEMVLLPLNEPVFGTKRKSQIQTYLEHNEGPGVQHLALMSDDIFRTLREMRRRSGVGGFDFMPSPPPTYYRNVKKRAGDVLTDDQIKECEELGILVDKDDQGTLLQIFTKPLGDRPTIFIEIIQRLGCMVKDDEGKVSQKGGCGGFGKGNFSELFKSIEEYEKTLGAKRIVDPAPV

SEQ ID NO: 340 - protein, 437 aa, Medicago truncatula
MAIETETQTQTQTGFKLVGFKNFVRANPKSDRFNVKRFHHVEFWCTDATNTARRFSHGLGMPIVAKSDLSTGNLTHASYLLRSGDLNFLFSAAYSPSISLSSPSSTAAIPTFSASTCFSFSASHGLAVRAVAVEVEDAEVAFTTSVNLGAIPSSPPVILENNVKLAEVHLYGDVVLRYVSYNDLNPNQNPNLFFLPGFERVSDESSNSSLDFGIRRLDHAVGNVPELSSAVKYVKQFTGFHEFAEFTAEDVGTSESGLNSVVLANNEETVLLPMNEPVYGTKRKSQIETYLEHNEGAGLQHLALMSADIFRTLREMRKRSGVGGFEFMPSPPVTYYRNLKNRVGDVLSDEQIKECEELGILVDRDDQGTLLQIFTKPIGDRPTIFIEIIQRVGCMLKDEEGKEYQKGGCGGFGKGNFSELFKSIEEYEKTLETRRTA

SEQ ID NO: 341 - protein, 152 aa, Zea mays
MPPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASV

SEQ ID NO: 342 - protein, 158 aa, Oryza sativa
MPPTPTPTATTGAVSAAAAAGENAGFRLVGHRRFVRANPRSDRFQALAFHHVELWCADAASAAGRFAFALGAPLAARSDLSTGNSAHASLLLRSASVAFLFTAPYGGDHGVGADAATTASIPSFSPGAARRFAADHGLAVHAVALRVADAADAFRASV

SEQ ID NO: 343 - protein, 152 aa, Avena sativa
MPPTPATATGAAAAAVTPEHAARSFPRVVRVNPRSDRFPVLSFHHVELWCADAASAAGRFSFALGAPLAARSDLSTGNSAHASLLLRSGALAFLFTAPYAPPPQEAATAAATASIPSFSADAARTFAAAHGLAVRSVGVRVADAAEAFRVSV

SEQ ID NO: 344 - protein, 146 aa, Hordeum vulgare
MPPTPTTPAATGAAAAVTPEHARPHRMVRFNPRSDRFHTLSFHHVEFWCADAASAAGRFAFALGAPLAARSDLSTGNSAHASQLLRSGSLAFLFTAPYANGCDAATASLPSFSADAARRFSADHGIAVRSVALRVADAAEAFRASR

SEQ ID NO: 345 - protein, 436 aa, Triticum aestivum; identical to SEQ ID NO: 331

SEQ ID NO: 346 - protein, 363 aa, Pseudommanas syringae
MADLYEADKYENPMGLMGFEFIEFASPTPNSLEPVFQMMGFTKVATHRSKDVTLYRQGAINLILNNEPHSLASYFAAEHGPSVCGMAFRVKDAQHAYNRALELGAQPLEIATGPMELRLPAIKGIGGAPLYLIDRFGEGTSIYDIDFNFIEGVDRHPVGAGLKFIDHLTHNVYRGRMAYWANFYEKLFNFRELRYFDIKGEYTGLTSKAMSAPDGMIRIPLNEESSKGAGQIEEFLMQFNGEGIQHVAFFTDDLIKTWDALKATGMRFMTAPPDTYYEMLQGRLPDHGEPEAELKSRGILLDGSSEGGERRLLLQIFSATLMGPVFFEFIQRKGDDGFGEGNFKALFESIERDQIQRGVLTPD

SEQ ID NO: 347 - protein, 94 aa, Legionella pneumophila
MQNNNPCGLDGFAFLEFSGPDRNKLHQQFSEMGFQAVAHHKNQDITLFKQGEIQFIVNAASHCQAEAHASTHGPGACAMGFKVKDAKAAFQHAI

SEQ ID NO: 348 - protein, 87 aa, Ralstonia solanacearum
MSAVTTAGFAFVEFVCAEPNELVALFGKLGFKALGQHAQTGAVLLRQNEAVLIVNPAPNPFRDVHGASARAIAINVDNAANALAQAL

SEQ ID NO: 349 - protein, 389 aa, Bacillus thuringiensis
MVLSMNHLIYLQGDEDFMKQKSMDTLAAQMEDFFPVRDVDHLEFYVGNAKQSSYYLARAFGFKIVAYSGLETGNREKVSYVLVQKNMRFVVSGALSSDNRIAEFVKTHGDGVKDVALLVDDVDKAYSEAVKRGAVAIAPPVELTDENGTLKKAVIGTYGDTIHTLVERKNYKGTFMPGFQKAEFDIPFEESGLIAVDHVVGNVEKMEEWVSYYENVMGFKQMIHFDDDDISTEYSALMSKVMTNGSRIKFPINEPADGKRKSQIQEYLEFYNGAGVQHLALLTNDIVKTVEALRANGVEFLDTPDTYYDELTARVGKIDEEIDKLKELKILVDRDDEGYLLQIFTKPIVDRPTLFIEIIQRKGSRGFGEGNFKALFESIEREQERRGNL

SEQ ID NO: 350 - protein, 365 aa, Chloroflexus aurantiacus
MCSADPLELLGIDYVEFYVSNARQAAHFYRTTLGLRPVAYAGLETGVRDRASYVLERRNVRFVLTAPLLPDHPIAQHIAHHGDGVKDIALRVRDAVTAYETAVARGGIPVQAPTEYVDEHGRIIKATIATYGDTVHSFIERENYQGTFMPGFQPITTPLPVPETGIAAIDHIVGNVELGAMNRWVNYYRDVLGFSQLVHFDDHDISTEYSALMSKVMQNGTGRIKFPINEPAEGRRKSQIEEFLEYYGGPGVQHIALATGDICATVDALRAAGIPFIHVPDAYYDDLEERVGKIDESRQALQERGILVDRDEEGYLLQIFSQPLQDRPTLFIEIIQRKGSRGFGKGNFKALFEAIEREQARRGNL

SEQ ID NO: 351 - protein, 115 aa, Acinetobacter
MTETATASAASATATKDPFPVKGMDAVVFAVGNAKQAAHYYSTAFGMRVVAYSGPETGRADRVAYVLESGSARFVFKGSVRPGTEIALHVAEHGDGVTDLAIAVPDVYAAYEYAV

SEQ ID NO: 352 - protein, 128 aa, Catenulispora acidphila
MTQAIDRPQSTEEVDVDALVGAVDHDITRDPFPVKGMDHVHFLVGNAKQAAHYYSTAFGMTCVAYRGPEQGYRDHAQYVLTSGSARFVLTGAVRPDADGAEHVAKHSDGVSDIALEVPDVDAAYAHAV

SEQ ID NO: 353 - protein, 128 aa, Micromonospora aurantiaca
MTQAIDRPQTSDEVDADLLVGAVDHDISHDPFPVKGLDHVQFLVGNAKQAAHYYSTAFGMTCVAYRGPEQGYRDHAQYVLTSGSARFVLTGAVRPDAAGAEQVARHSDGVCDIALEVPDVDAAHAHAI

SEQ ID NO: 354 - protein, 133 aa, Calinispora tropica
MSLEQALNDDERLAQLDLDQLKQLVGLVEYDASGDPFPVSGWDALVWVVGNATQAAHFHQSAFGMELVAYSGPETGNRDHLAYVLESGAARFVVRGAYDPASPLADHHRKHGDGIVDIALSVPDVDRCIAHAA

SEQ ID NO: 355 - protein, 401 aa, Geodermatophilus obscurus
MSLEQALNDDERLAQLDLDQLKQLVGLVEYDASGDPFPVSGWDALVWVVGNATQAAHFHQSAFGMELVAYSGPETGNRDHLAYVLESGAARFVVRGAYDPASPLADHHRKHGDGIVDIALSVPDVDRCIAHAAAQGATVLEQPHDISDEFGTVRIGAIATYGDTRHTLVDRSRYTGPYLPGYVERRSSHVKRDGAPKRLFQAVDHVVGNVELGAMDRWVEFYNRVMGFTNMAEFVGEDIATDYSALMSKVVANGNHRVKFPLNEPAIGKKKSQIDEYLEFYGGPGAQHVALATNDILTTVDALRAEGIEFLATPDSYYEDPELRARIGEVRAPIEELQERGVLVDRDEDGYLLQIFTKPLGDRPTVFFELIERHGSLGFGIGNFKALFEAIEREQHKRGNF

SEQ ID NO: 356 - protein, 400 aa, Kibbella flavida
MTSTDLTPAELDADLDLDQLKQLVGLVPYDESTDPFPVTAMDAVVFVVGNATQTAKFYQLAFGMDLVAYAGPETGSKDAKYFVLKAGSARFVISGGVRPDSPLLDHHRKHGDGVVDLALEVPDVDKCVKHARAMGATVLEEPNDVSDEHGTVRRAAIAAYGDTRHTLIDRSRYDGPYLPGFVAATTAVTRPEGHPKRLFQAVDHVVGNVELGKMDEWVGFYNKVMGFVNMAEFIGDDIATDYSALMSKVVANGNHRVKFPLNEPAIAKKKSQIDEFLEFYDGAGAQHIALATNDILRTVDIMRANGVEFLNTPDSYYEDPELRARIGNVRAPIEELQARGILVDRDEDGYLLQIFTAPIGDRPTVFYELIERHGSLGFGKGNFKALFEAIEREQERRGNL

SEQ ID NO: 357 - protein, 94 aa, Streptomyces avermitilis
MDILENPLELCGFAFIEFVSKENELDPIFETIGFSKVAKHKSKKAYLWRQGNINIILNYQPESYASFFFNEHGPSACAMGFKTRDAAKAFKKAV

SEQ ID NO: 358 - protein, 142 aa, Ostreococcus tauri
MTTSASGRKLVGHANFVRCNPLSDAFECVGFDHVEFWCGDATNAASRFGVGLGMSLRAKSDASTGNGIYASYAMKSHDLTFVFTAPYGDDERAVGCGGSSVNVPHPGNERGAMMRFFERHGLAARAVGLRVGDARAAYEEAM

SEQ ID NO: 359 - protein, 442 aa, Daucus carota; identical to SEQ ID NO: 332

SEQ ID NO: 360 - protein, 144 aa, Solernostemon scutellariuides
MGQESTAAAAVVPAEFKLVGHKNFVRSNPMSDHFPVHRFHHVEFWCGDATNTSRRFSWGLGMPLVAKSDLSTGNSAHASYLLRSGELSFVFTAPYSPSLAEPSSASIPTFSFSDHRAFTSSHGLAVRAVAIQVDSASSAYSAAV

SEQ ID NO: 361 - protein, 159 aa, Brassica rapa
MGHENAAVSENQHHDDAATTSASPGFKLVGFSKFVRKNPKSDKFKVKRFHHIEFWCGDATNVARRFSWGLGMRFSAKSDLSTGNMVHASYLLTSGDLRFLFTAPYSPSLSAGENPPTTTASIPSFDHVTYRSFFSSHGLGVRAVAVEVEDAEAAFSISV

SEQ ID NO: 362 - protein, 140 aa, Coptis japonica
MVPSTASNLKLVGHTNFVHNNPKSDKFHVKKFHHIEFWSTDATNTARRFSWGLGMPMVAKSDLSTGNMVHASYLLRSGELNFLFTAPYSPSIAGNTLTHTASIPTYSHNLARLFASTHGLAVRAIAIEVQDAELAYNISV

SEQ ID NO: 363 - protein, 155 aa, Glycine max
MAIPMCNEIQAQAQAQAQAQPGFKLVGFKNFVRTNPKSDRFQVNRFHHIEFWCTDATNASRRFSWGLGMPIVAKSDLSTGNQIHASYLLRSGDLSFLFSAPYSPSLSAGSSAASSASIPSFDAATCLAFAAKHGFGVRAIALEVADAEAAFSASV

SEQ ID NO: 364 - protein, 148 aa, Vitis vinifera
MGKQNTTTNNPAPGFKLVGFSNFLRTNPMSDRFGVKRFHHIEFWSTDATNLARRFSWGLGMPIVAKSDLSTGNVIHASYLTRSGDLNFLFTAPYSPSIAGDLENAAATASIPSFDHSACHAFAASHGLGVRAIAIEVDDAEGAFHTSV

SEQ ID NO: 365 - protein, 146 aa, Medicago truncatula
MAIETETQTQTQTGFKLVGFKNFVRANPKSDRFNVKRFHHVEFWCTDATNTARRFSHGLGMPIVAKSDLSTGNLTHASYLLRSGDLNFLFSAAYSPSISLSSPSSTAAIPTFSASTCFSFSASHGLAVRAVAVEVEDAEVAFTTSV

SEQ ID NO: 366 - protein, 111 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKAR

SEQ ID NO: 367 - protein, 111 aa, Tattus norvegicus
MTTYSNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKAR

SEQ ID NO: 368 - protein, 111 aa, Mus musculus
MTTYNNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKAR

SEQ ID NO: 369 - protein, 111 aa, Bos Taurus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKAR

SEQ ID NO: 370 - protein, 8 aa, Artificial Sequence
  HPPD variant
TATAAGAA

SEQ ID NO: 371 - protein, 23 aa, Zea mays
MGPTPTAAAAGAAVAAASAAEQA

SEQ ID NO: 372 - protein, 6 aa, Artificial Sequence
  HPPD motif
ASPGAV

SEQ ID NO: 373 - protein, 5 aa, Artificial Sequence
  HPPD motif
VVNVP

SEQ ID NO: 374 - protein, 5 aa, Artificial Sequence
  HPPD motif
AYLAG

SEQ ID NO: 375 - protein, 4 aa, Artificial Sequence
  HPPD motif
SMAL

SEQ ID NO: 376 - protein, 6 aa, Artificial Sequence
  HPPD motif
IAVASD

SEQ ID NO: 377 - protein, 6 aa, Artificial Sequence
  HPPD motif
LPPPPS

SEQ ID NO: 378 - protein, 6 aa, Artificial Sequence
  HPPD motif
MPPPPS

SEQ ID NO: 379 - protein, 5 aa, Artificial Sequence
  HPPD motif
RREAG

SEQ ID NO: 380 - protein, 5 aa, Artificial Sequence
  HPPD motif
RRCAG

SEQ ID NO: 381 - protein, 4 aa, Artificial Sequence
  HPPD motif
GVMV

SEQ ID NO: 382 - protein, 4 aa, Artificial Sequence
  HPPD motif
NFGQ

SEQ ID NO: 383 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKANFGQLFKSIEDYEKSLEAKQAAAAATAQGS

SEQ ID NO: 384 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRIAGDVLTEAQINECQELGVMVDRDDQGVLLQIFTKPVGDRPTFFLEIIQRIGCMEKDEKGQEYQKGGCGGFGKANFGQLFKSIEDYEKSLEAKQAAAAATAQGS

SEQ ID NO: 385 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRIAGDVLTEAQINECQELGVMVDRDDQGVLLQIFTKPVGDRPTFFLEIIQRIGCMEKDEKGQEYQKGGCGGFGKKNFGQLFKSIEDYEKSLEAKQAAAAATAQGS

SEQ ID NO: 386 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKKNFGQLFKSIEDYEKSLEAKQAAAAATAQGS

SEQ ID NO: 387 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKANFGQLFKSIEDYEKSLEAKQAAAAATAQGS

SEQ ID NO: 388 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKHNFGQLFKSIEDYEKSLEAKQAAAAATAQGS

SEQ ID NO: 389 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKRNFGQLFKSIEDYEKSLEAKQAAAAATAQGS

SEQ ID NO: 390 - protein, 444 aa, Artificial Sequence; identical to SEQ ID NO: 389
  HPPD variant

SEQ ID NO: 391 - protein, 358 aa, Streptomyces avermitilis
MADLYENPMGLMGFEFIEFASPTPGTLEPIFEIMGFTKVATHRSKNVHLYRQGEINLILNNEPNSIASYFAAEHGPSVCGMAFRVKDSQKAYNRALELGAQPIHIDTGPMELNLPAIKGIGGAPLYLIDRFGEGSSIYDIDFVYLEGVERNPVGAGLKVIDHLTHNVYRGRMVYWANFYEKLFNFREARYFDIKGEYTGLTSKAMSAPDGMIRIPLNEESSKGAGQIEEFLMQFNGEGIQHVAFLTDDLVKTWDALKKIGMRFMTAPPDTYYEMLEGRLPDHGEPVDQLQARGILLDGSSVEGDKRLLLQIFSETLMGPVFFEFIQRKGDDGFGEGNFKALFESIERDQVRRGVLTAD

SEQ ID NO: 392 - protein, 444 aa, Zea mays
MPPTPTAAAAGAAVAAASAAEQAAFRLVGHRNFVRFNPRSDRFHTLAFHHVELWCADAASAAGRFSFGLGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMVLANNSENVLLPLNEPVHGTKRRSQIQTFLDHHGGPGVQHMALASDDVLRTLREMQARSAMGGFEFMAPPTSDYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAAAAQGS

SEQ ID NO: 393 - protein, 440 aa, Artificial Sequence
  HPPD variant
MPPTPTTAAATGAAVAAASAEQAAFRLVGHRNFVRVNPRSDRFHTLAFHHVELWCADAASAAGRFSFGLGAPLAARSDLSTGNTAHASLLLRSGALAFLFTAPYAHGADAATASLPSFSAAEARRFAADHGLAVRAVALRVADAEDAFRASVAAGARPAFEPVELGLGFRLAEVELYGDVVLRYVSYPDDADASFLPGFVGVASPGAVDYGLRRFDHIVVNVPELAPAAAYLAGFTGFHEFAEFTAEDVGTTESGLNSMALANNAENVLLPLNEPVHGTKRRSQIQTYLDHHGGPGVQHIAVASDDVLRTLREMQARSAMGGFEFMPPPPSEYYDGVRRCAGDVLTEAQIKECQELGVMVDRDDQGVLLQIFTKPVGDRPTLFLEIIQRIGCMEKDEKGQEYQKGGCGGFGKGNFGQLFKSIEDYEKSLEAKQAAAAQGS

SEQ ID NO: 394 - protein, 440 aa, Sorghum bicolor
MPPTPTTAAATGAAVAAASAEQAAFRLVGHRNFVRVNPRSDRFHTLAFHHVELWCADAASAAGRFSFGLGAPLAARSDLSTGNTAHASLLLRSGALAFLFTAPYAHGADAATASLPSFSAAEARRFAADHGLAVRAVALRVADAEDAFRASVAAGARPAFEPVELGLGFRLAEVELYGDVVLRYVSYPDDADASFLPGFVGVTSPGAADYGLRRFDHIVGNVPELAPAAAYFAGFTGFHEFAEFTAEDVGTTESGLNSMVLANNAENVLLPLNEPVHGTKRRSQIQTYLDHHGGPGVQHMALASDDVLRTLREMQARSAMGGFEFMAPPAPEYYDGVRRRAGDVLTEAQIKECQELGVLVDRDDQGVLLQIFTKPVGDRPTLFLEIIQRIGCMEKDEKGQEYQKGGCGGFGKGNFSQLFKSIEDYEKSLEAKQAAAAQGS

SEQ ID NO: 395 - protein, 443 aa, Artificial Sequence
  HPPD variant
  VARIANT 393: Xaa = Any Amino Acid
MCNEIQAQAQAQAQPGFKLVGFKNFVRTNPKSDRFQVNRFHHIEFWCTDATNASRRFSWGLGMPIVAKSDLSTGNQIHASYLLRSGDLSFLFSAPYSPSLSAGSSAASSASIPSFDAATCLAFAAKHGFGVRAIALEVADAEAAFSASVAKGAEPASPPVLVDDRTGFAEVRLYGDVVLRYVSYKDAAPQAPHADPSRWFLPGFEAAASSSSFPEVDYGIRRLDHAVVNVPELAPAVAYLAGFSGFHEFAEFTAEDVGTSESGLNSMALANNSETVLLPLNEPVYGTKRKSQIETYLEHNEGAGVQHLIAVASDIFTTLREMRKRSFLGGFEFMPPPPPSYYANLRRCAGDVLTVDQIKQCEELGVMVDRDDQGTLLQIFTKPVGDRPTIFIXIIQRIGCMVEDEEGKVYQKGACGGFGKGNFGQLFKSIEEYEKTLEAKRTA

SEQ ID NO: 396 - protein, 443 aa, Glycine max
  VARIANT 393: Xaa = Any Amino Acid
MCNEIQAQAQAQAQPGFKLVGFKNFVRTNPKSDRFQVNRFHHIEFWCTDATNASRRFSWGLGMPIVAKSDLSTGNQIHASYLLRSGDLSFLFSAPYSPSLSAGSSAASSASIPSFDAATCLAFAAKHGFGVRAIALEVADAEAAFSASVAKGAEPASPPVLVDDRTGFAEVRLYGDVVLRYVSYKDAAPQAPHADPSRWFLPGFEAAASSSSFPELDYGIRRLDHAVGNVPELAPAVRYLKGFSGFHEFAEFTAEDVGTSESGLNSVVLANNSETVLLPLNEPVYGTKRKSQIETYLEHNEGAGVQHLALVTHDIFTTLREMRKRSFLGGFEFMPSPPPTYYANLHNRAADVLTVDQIKQCEELGILVDRDDQGTLLQIFTKPVGDRPTIFIXIIQRIGCMVEDEEGKVYQKGACGGFGKGNFSELFKSIEEYEKTLEAKRTA

SEQ ID NO: 397 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRREAGDVLTEAQINECQELGVMVDRDDQGVLLQIFTKPVGDRPTFFLEIIQRIGCMEKDEKGQEYQKGGCGGFGKANFGQLFKSIEDYEKSLEAKQAAAAATAQGS

SEQ ID NO: 398 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRIAGDVLTEAQINECQELGVMVDRDDQGVLLQIFTKPVGDRPTFFLEIIQRIGCMEKDEKGQEYQKGGCGGFGKANFGQLFKSIEDYEKSLEAKQAAAAATAQGS

SEQ ID NO: 399 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRIAGDVLTEAQINECQELGVMVDRDDQGVLLQIFTKPVGDRPTFFLEIIQRIGCMEKDEKGQEYQKGGCGGFGKKNFGQLFKSIEDYEKSLEAKQAAAAATAQGS

SEQ ID NO: 400 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKKNFGQLFKSIEDYEKSLEAKQAAAAATAQGS

SEQ ID NO: 401 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKANFGQLFKSIEDYEKSLEAKQAAAAATAQGS

SEQ ID NO: 402 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKHNFGQLFKSIEDYEKSLEAKQAAAAATAQGS

SEQ ID NO: 403 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKRNFGQLFKSIEDYEKSLEAKQAAAAATAQGS

SEQ ID NO: 404 - protein, 444 aa, Artificial Sequence; identical to SEQ ID NO: 386
  HPPD variant

SEQ ID NO: 405 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 406 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMRARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 407 - protein, 444 aa, Artificial Sequence
  HPPD variant
MGPTPTATAAGAAVAAASAAEQAAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 408 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 409 - protein, 444 aa, Artificial Sequence
  HPPD variant
MGPTPTATAAGAAVAAASAAEQAAFRLVGHRNFVRFNPRADRFHTVAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPDLAPAAAYMAGFTGFHEFAEFTTEDVGTAESGLNSMALANNSENVLLPLNEPVHGTKRRSQIQTFLDHHGGPGVQHIALASDDVLRTLREMRARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 410 - protein, 444 aa, Artificial Sequence
  HPPD variant
MGPTPTATAAGAAVAAASAAEQAAFRLVGHRNFVRFNPRADRFHTVAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPDLAPAAAYFAGFTGFHEFAEFTTEDVGTAESGLNSMALANNSENVLLPLNEPVHGTKRRSQIQTFLDHHGGPGVQHIALASDDVLRTLREMRARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 411 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 412 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGGGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSSMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAAKAQGS

SEQ ID NO: 413 - protein, 444 aa, Artificial Sequence
  HPPD variant
MGPTPTATAAGAAVAAASAAEQAVFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 414 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGAPLAARSDLSTGNSAHASLLLRSGSLSFLFTAPYAHGADAATAALPSFSPAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAAKAQGS

SEQ ID NO: 415 - protein, 444 aa, Artificial Sequence
  HPPD variant
MGPTPTATAAGAAVAAASAAEQAAFRLVGHRNFVRFNPRSDRFITLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 416 - protein, 444 aa, Artificial Sequence
  HPPD variant
MGPTPTATAAGAAVAAASAAEQAAFRLVGHRNFVRFNPRSDRFCTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 417 - protein, 444 aa, Artificial Sequence
  HPPD variant
MGPTPTATAAGAAVAAASAAEQAAFRLVGHRNFVRFNPRSDRFSTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 418 - protein, 444 aa, Artificial Sequence
  HPPD variant
MGPTPTATAAGAAVAAASAAEQAAFRLVGHRNFVRFNPRSDRFGTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 419 - protein, 444 aa, Artificial Sequence
  HPPD variant
MGPTPTATAAGAAVAAASAAEQAAFRLVGHRNFVRFNPRSDRFVTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 420 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYCAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 421 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 422 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYIAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 423 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYVAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 424 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMKARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 425 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPGSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 426 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPQSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 427 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPHSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 428 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRDAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 429 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRAAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 430 - protein, 444 aa, Artificial Sequence
  HPPD variant
MGPTPTATAAGAAVAAASAAEQAAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVLVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 431 - protein, 422 aa, Artificial Sequence; identical to SEQ ID NO: 400
  HPPD variant

SEQ ID NO: 432 - protein, 422 aa, Artificial Sequence
  HPPD variant
MAFRLVGHRNFVRFNPRSDRFQTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 433 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMRARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 434 - protein, 422 aa, Artificial Sequence
  HPPD variant
MAFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 435 - protein, 422 aa, Artificial Sequence
  HPPD variant
MAFRLVGHRNFVRFNPRSDRFQTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 436 - protein, 422 aa, Artificial Sequence
  HPPD variant
MAFRLVGHRNFVRFNPRADRFHTVAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPDLAPAAAYMAGFTGFHEFAEFTTEDVGTAESGLNSMALANNSENVLLPLNEPVHGTKRRSQIQTFLDHHGGPGVQHIALASDDVLRTLREMRARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 437 - protein, 422 aa, Artificial Sequence
  HPPD variant
MAFRLVGHRNFVRFNPRADRFHTVAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPDLAPAAAYFAGFTGFHEFAEFTTEDVGTAESGLNSMALANNSENVLLPLNEPVHGTKRRSQIQTFLDHHGGPGVQHIALASDDVLRTLREMRARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 438 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 439 - protein, 422 aa, Artificial Sequence
  HPPD variant
MAFRLVGHRNFVRFNPRSDRFQTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGGGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSSMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAAKAQGS

SEQ ID NO: 440 - protein, 422 aa, Artificial Sequence
  HPPD variant
MVFRLVGHRNFVRFNPRSDRFHTLAFHHVELWCADAASAAGRFSFALGAPLAARSDLSTGNSAHASLLLRSGSLSFLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 441 - protein, 422 aa, Artificial Sequence
  HPPD variant
MAFRLVGHRNFVRFNPRSDRFQTLAFHHVELWCADAASAAGRFSFALGAPLAARSDLSTGNSAHASLLLRSGSLSFLFTAPYAHGADAATAALPSFSPAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYFAGFTGFHEFAEFTTEDVGTAESGLNSMALANNSENVLLPLNEPVHGTKRRSQIQTFLDHHGGPGVQHIALASDDVLRTLREMQARSAMGGFEFLPPPPSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAAKAQGS

SEQ ID NO: 442 - protein, 422 aa, Artificial Sequence
  HPPD variant
MAFRLVGHRNFVRFNPRSDRFITLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 443 - protein, 422 aa, Artificial Sequence
  HPPD variant
MAFRLVGHRNFVRFNPRSDRFCTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 444 - protein, 422 aa, Artificial Sequence
  HPPD variant
MAFRLVGHRNFVRFNPRSDRFSTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 445 - protein, 422 aa, Artificial Sequence
  HPPD variant
MAFRLVGHRNFVRFNPRSDRFGTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 446 - protein, 422 aa, Artificial Sequence
  HPPD variant
MAFRLVGHRNFVRFNPRSDRFVTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 447 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYCAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 448 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYLAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 449 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYIAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 450 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYVAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 451 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMKARSAMGGFEFLPPPLSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 452 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPGSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 453 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPQSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 454 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPHSDYYDGVRRCAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 455 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRDAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 456 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRAAGDVLTEAQINECQELGVMVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 457 - protein, 422 aa, Artificial Sequence
  HPPD variant
MAFRLVGHRNFVRFNPRSDRFQTLAFHHVELWCADAASAAGRFSFALGVPLAARSDLSTGNSAHASLLLRSGSLSLLFTAPYAHGADAATAALPSFSAAAARRFAADHGLAVRAVALRVADAEDAFRASVAAGARPAFGPVDLGRGFRLAEVELYGDVVLRYVSYPDGAAGEPFLPGFEGVASPGAADYGLSRFDHIVGNVPELAPAAAYMAGFTGFHEFAEFTTEDVGTTESGLNSMALANNSENVLLPLNEPVHGTKRRSQIQTFLDHHGGPGVQHIALASDDVLRTLREMQARSAMGGFEFLPPPLSDYYDGVRRCAGDVLTEAQINECQELGVLVDRDDQGVLLQIFTKPVGDRPTFFLEIIQRIGCMEKDEKGQEYQKGGCGGFGKGNFGQLFKSIEDYEKSLEAKQAAAAATAQGS

SEQ ID NO: 458 - protein, 455 aa, Artificial Sequence
  HPPD variant
MPIPMCNEIQAQAQAQAQAQPGFKLVGFKNFVRTNPKSDRFQVNRFHHIEFWCTDATNASRRFSWGLGMPIVAKSDLSTGNQIHASYLLRSGDLSFLFSAPYSPSLSAGSSAASSASIPSFDAATCLAFAAKHGFGVRAIALEVADAEAAFSASVAKGAEPASPPVLVDDRTGFAEVRLYGDVVLRYVSYKDAAPQAPHADPSRWFLPGFEAAASSSSFPELDYGIRRLDHAVGNVPELAPAVAYMAGFSGFHEFAEFTAEDVGTSESGLNSMALANNSETVLLPLNEPVYGTKRKSQIETYLEHNEGAGVQHLALVTHDIFTTLREMRKRSFLGGFEFMPSPPPTYYANLHNCAADVLTVDQIKQCEELGIMVDRDDQGTLLQIFTKPVGDRPTIFIEIIQRIGCMVEDEEGKVYQKGACGGFGKGNFGELFKSIEEYEKTLEAKRTAGLTVNS

SEQ ID NO: 459 - protein, 440 aa, Artificial Sequence
  HPPD variant
MPPTPTTAAATGAAVAAASAEQAAFRLVGHRNFVRVNPRSDRFHTLAFHHVELWCADAASAAGRFSFGLGAPLAARSDLSTGNTAHASLLLRSGALAFLFTAPYAHGADAATASLPSFSAAEARRFAADHGLAVRAVALRVADAEDAFRASVAAGARPAFEPVELGLGFRLAEVELYGDVVLRYVSYPDDADASFLPGFVGVTSPGAADYGLRRFDHIVGNVPELAPAAAYMAGFTGFHEFAEFTAEDVGTTESGLNSMALANNAENVLLPLNEPVHGTKRRSQIQTYLDHHGGPGVQHIALASDDVLRTLREMQARSAMGGFEFLPPPLSEYYDGVRRCAGDVLTEAQIKECQELGVMVDRDDQGVLLQIFTKPVGDRPTLFLEIIQRIGCMEKDEKGQEYQKGGCGGFGKGNFGQLFKSIEDYEKSLEAKQAAAAQGS

SEQ ID NO: 460 - protein, 4 aa, Artificial Sequence
  HPPD motif
  VARIANT (3)...(3): The amino acid residue at position 3 can also be C.
AYMA

SEQ ID NO: 461 - protein, 6 aa, Artificial Sequence
  HPPD motif
  VARIANT (5)...(5): The amino acid residue at position 5 can also be G, Q, or H.
LPPPLS

SEQ ID NO: 462 - protein, 5 aa, Artificial Sequence
  HPPD motif
RRDAG

SEQ ID NO: 463 - protein, 4 aa, Artificial Sequence
  HPPD motif
  VARIANT (2)...(2): The amino acid residue at position 2 can also be A, H, R, F, M, Q, S, V, or Y.
KKNF

SEQ ID NO: 464 - protein, 86 aa, glycine max
MPMYTPSLSAPSSNHIQPSVTLPLYITTTKLNLKQQHHTTPMPIPMCNEIQAQAQAQAQPGFKLVGFKNFVRTNPKSDRFQVNRFH

SEQ ID NO: 465 - protein, 488 aa, Glycine max
MPMYTPSLSAPSSNHIQPSVTLPLYITTTKLNLKQQHHTTPMPIPMCNEIQAQAQAQAQPGFKLVGFKNFVRTNPKSDRFQVNRFHHIEFWCTDATNASRRFSWGLGMPIVAKSDLSTGNQIHASYLLRSGDLSFLFSAPYSPSLSAGSSAASSASIPSFDAATCLAFAAKHGFGVRAIALEVADAEAAFSASVAKGAEPASPPVLVDDRTGFAEVRLYGDVVLRYVSYKDAAPQAPHADPSRWFLPGFEAAASSSSFPELDYGIRRLDHAVGNVPELAPAVRYLKGFSGFHEFAEFTAEDVGTSESGLNSVVLANNSETVLLPLNEPVYGTKRKSQIETYLEHNEGAGVQHLALVTHDIFTTLREMRKRSFLGGFEFMPSPPPTYYANLHNRAADVLTVDQIKQCEELGILVDRDDQGTLLQIFTKPVGDRPTIFIEIIQRIGCMVEDEEGKVYQKGACGGFGKGNFSELFKSIEEYEKTLEAKRTA

SEQ ID NO: 466 - protein, 351 aa, Acinetobacter sp
MDILENPLELCGFAFIEFVSKENELDPIFETIGFSKVAKHKSKEAYLWRQGNINIILNYQPESYASFFFNEHGPSACAMGFKTRDAAKAFQKAVELGAEPMYSKVGPMELNIPAIKGIGGMPIFLVDRDIYENDFTFFDDAQRHPVGAGLNEIDHLTHNVYKGRMEYWANFYEKIFNFQEIRYFDIKGEYTGLTSKALTAPDGKIRIPLNEDSDKGNGQIAEFLSDFNGEGIQHIAFICDDLISTWDKLKGLGLKFMTPPPNTYYEMLPERLPEHGEPTEELKQRGILLDGNTKDGQKKLLLQIFSENMIGPVFFEFIQRKDDDGFGEGNFKALFESIERDQIRRGVLEAK

SEQ ID NO: 467 - protein, 363 aa, Pseudomanas syringae; identical to SEQ ID NO: 346

SEQ ID NO: 468 - protein, 348 aa, Legionella pneumophila
MQNNNPCGLDGFAFLEFSGPDRNKLHQQFSEMGFQAVAHHKNQDITLFKQGEIQFIVNAASHCQAEAHASTHGPGACAMGFKVKDAKAAFQHAIAHGGIAFQDAPHANHGLPAIQAIGGSVIYFVDEEHQPFSHEWNITSPEPVVGNGLTAIDHLTHNVYRGNMDKWASFYASIFNFQEIRFFNIKGKMTGLVSRALGSPCGKIKIPLNESKDDLSQIEEFLHEYHGEGIQHIALNTNDIYKTVNGLRKQGVKFLDVPDTYYEMINDRLPWHKEPLNQLHAEKILIDGEADPKDGLLLQIFTENIFGPVFFEIIQRKGNQGFGEGNFQALFEAIERDQVRRGTLKELS

SEQ ID NO: 469 - protein, 346 aa, Ralstonia solanacearum
MSAVTTAGFAFVEFVCAEPNELVALFGKLGFKALGQHAQTGAVLLRQNEAVLIVNPAPNPFRDVHGASARAIAINVDNAANALAQALEGGARRATPAEFGAFVVDAQAIVGIGDSLVYFVDHDIESVFSTPYRPRQPVDVANAAIQAIDHTSNIVKPENLDHWADFYKDTFAFVQKQYLDVKGRQTGMRARSMVSPCGKVSIPIAAAAHDQPGVLNQNDEFIRDYRGEGIQHIAFLSSNIEQTIAAMEKAGIDFMDTPPKTYYQNLDVRVPGHGQNLDSVERRGILVDGKGDGRILLQRFTRRQIGPIFFELIERRGEDGFGEGNFKALFESQEQDQVRRGSLNAS

SEQ ID NO: 470 - protein, 389 aa, Bacillus thuringiensis; identical to SEQ ID NO: 349

SEQ ID NO: 471 - protein, 365 aa, Chloroflexus aurantiacus; identical to SEQ ID NO: 350

SEQ ID NO: 472 - protein, 379 aa, Catenulispora acidphila
MTETATASAASATATKDPFPVKGMDAVVFAVGNAKQAAHYYSTAFGMRVVAYSGPETGRADRVAYVLESGSARFVFKGSVRPGTEIALHVAEHGDGVTDLAIAVPDVYAAYEYAVGHGATGLEKPHEVEDENGVLVRAAIATYGDTRHSLVDRSRYTGAYAPGYVERAPLVEPNARIFQAIDHCVGNVELGKMDEWVDFYRHVMGFTNMAEFIGDDIATDYSALMSKVVADGTRKVKFPLNEPAIAKKKSQIDEYLEFYGGPGVQHIALNTGDILATVDAMRAAGVEFLETPDSYYEDEELRARIGTVRVPVEELQKRKILVDRDEEGYLLQIFTKPVQDRPTVFFELIERHGSQGFGKGNFKALFEAIEREQERRGNL

SEQ ID NO: 473 - protein, 401 aa, Micromonospora aurantiaca
MTQAIDRPQSTEEVDVDALVGAVDHDITRDPFPVKGMDHVHFLVGNAKQAAHYYSTAFGMTCVAYRGPEQGYRDHAQYVLTSGSARFVLTGAVRPDADGAEHVAKHSDGVSDIALEVPDVDAAYAHAVAQGATGLVEPHDVSDEHGTVRMASIAAYGDTRHSLVDRSRYTGPFLPGFVARGPIVDRQPMIDAGLQPKRFFQAVDHVVGNVELGRMDEWVEFYKRVMGFSNMAEFIGDDIATDYSALMSKVVANGTRKVKFPLNEPAVARKKSQIDEYLEFYQGPGAQHIAVATNDILASVDAMRAAGVEFLDTPDSYYEDPELRARIGNVRVPIEELQSRKILVDRDEDGYLLQIFTKPVQDRPTVFFELIERHGSLGFGKGNFKALFEAIEREQEKRGNL

SEQ ID NO: 474 - protein, 401 aa, Salinispora tropica
MTQAIDRPQTSDEVDADLLVGAVDHDISHDPFPVKGLDHVQFLVGNAKQAAHYYSTAFGMTCVAYRGPEQGYRDHAQYVLTSGSARFVLTGAVRPDAAGAEQVARHSDGVCDIALEVPDVDAAHAHAIAQGAISLAEPYEVSDEHGTVRLAAIATYGDTRHTLVDRSRYHGPFLPGYVARRPIVDRQPMIDAGVQPKRFFQAIDHVVGNVELGRMDEWVEFYQRVMGFTNMAEFVGDDIATDYSALMSKVVANGTRKVKFPLNEPAVARKKSQIDEYLDFYQGPGAQHIAVATNDILASVDAMRAAGVDFLDTPDSYYDDPELRARIGEVRVPIEELKARRILVDRDEDGYLLQIFTNPVQDRPTVFFELIERHGSLGFGKGNFKALFEAIEREQDKRGNL

SEQ ID NO: 475 - protein, 401 aa, Geodermatophilus obscurus; identical to SEQ ID NO: 355

SEQ ID NO: 476 - protein, 400 aa, Kribbella flavida; identical to SEQ ID NO: 356

SEQ ID NO: 477 - protein, 380 aa, Streptomyces aver
MTQTTHHTPDTARQADPFPVKGMDAVVFAVGNAKQAAHYSTAFGMQLVAYSGPENGSRETASYVLTNGSARFVLTSVIKPATPWGHFLADHVAEHGDGVVDLAIEVPDARAAHAYAIEHGARSVAEPYELKDEHGTVVLAAIATYGKTRHTLVDRTGYDGPYLPGYVAAAPIVEPPAHRTFQAIDHCVGNVELGRMNEWVGFYNKVMGFTNMKEFVGDDIATEYSALMSKVVADGTLKVKFPINEPALAKKKSQIDEYLEFYGGAGVQHIALNTGDIVETVRTMRAAGVQFLDTPDSYYDTLGEWVGDTRVPVDTLRELKILADRDEDGYLLQIFTKPVQDRPTVFFEIIERHGSMGFGKGNFKALFEAIEREQEKRGNL

SEQ ID NO: 478 - protein, 442 aa, Ostreococcus tauri; identical to SEQ ID NO: 332

SEQ ID NO: 479 - protein, 442 aa, Daucus carota; identical to SEQ ID NO: 332

SEQ ID NO: 480 - protein, 436 aa, Solenostemon scutellarioides; identical to SEQ ID NO: 333

SEQ ID NO: 481 - protein, 443 aa, Brassica rapa; identical to SEQ ID NO: 337

SEQ ID NO: 482 - protein, 430 aa, Coptis Japonica; identical to SEQ ID NO: 338

SEQ ID NO: 483 - protein, 443 aa, Glycine max; identical to SEQ ID NO: 396
  VARIANT 393: Xaa = Any Amino Acid

SEQ ID NO: 484 - protein, 445 aa, Vitis vinifera; identical to SEQ ID NO: 339

SEQ ID NO: 485 - protein, 437 aa, Medicago truncatula; identical to SEQ ID NO: 340

SEQ ID NO: 486 - protein, 393 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 487 - protein, 393 aa, Rattus norvegicus
MTTYSNKGPKPERGRFLHFHSVTFWVGNAKQAASFYCNKMGFEPLAYKGLETGSREVVSHVIKQGKIVFVLCSALNPWNKEMGDHLVKHGDGVKDIAFEVEDCEHIVQKARERGAKIVREPWVEEDKFGKVKFAVLQTYGDTTHTLVEKINYTGRFLPGFEAPTYKDTLLPKLPSCNLEIIDHIVGNQPDQEMESASEWYLKNLQFHRFWSVDDTQVHTEYSSLRSIVVANYEESIKMPINEPAPGRKKSQIQEYVDYNGGAGVQHIALRTEDIITTIRHLRERGMEFLAVPSSYYRLLRENLKTSKIQVKENMDVLEELKILVDYDEKGYLLQIFTKPMQDRPTLFLEVIQRHNHQGFGAGNFNSLFKAFEEEQALRGNLTDLETNGVRSGM

SEQ ID NO: 488 - protein, 393 aa, Mus musculus
MTTYNNKGPKPERGRFLHFHSVTFWVGNAKQAASFYCNKMGFEPLAYRGLETGSREVVSHVIKQGKIVFVLCSALNPWNKEMGDHLVKHGDGVKDIAFEVEDCDHIVQKARERGAKIVREPWVEQDKFGKVKFAVLQTYGDTTHTLVEKINYTGRFLPGFEAPTYKDTLLPKLPRCNLEIIDHIVGNQPDQEMQSASEWYLKNLQFHRFWSVDDTQVHTEYSSLRSIVVTNYEESIKMPINEPAPGRKKSQIQEYVDYNGGAGVQHIALKTEDIITAIRHLRERGTEFLAAPSSYYKLLRENLKSAKIQVKESMDVLEELHILVDYDEKGYLLQIFTKPMQDRPTLFLEVIQRHNHQGFGAGNFNSLFKAFEEEQALRGNLTDLEPNGVRSGM

SEQ ID NO: 489 - protein, 393 aa, Bos taurus
MTTYSDKGEKPERGRFLHFHSVTFWVGNAKQAASYYCSKLGFEPLAYKGLETGSREVVSHVVKQGQIVFVFSSALNPWNKEMGDHLVKHGDGVKDIAFEVEDCDYIVQKARERGAKIVREPWVEQDKLGKVKFAVLQTYGDTTHTLVEKMNYTGRFLPGFEAPPFMDPQLSKLPSCSLEIIDHIVGNQPDQEMVSASEWYLKNLQFHRFWSVDDTQVHTEYSSLRSVVVANYEESIKMPINEPAPGKKKSQIQEYVDYNGGAGVQHIALKTKDIITAIRHLRERGVEFLAVPSTYYKQLREKLKMAKIRVKENIDILEELKILVDYDEKGYLLQIFTKPMQDRPTLFLEVIQRHNHQGFGAGNFNSLFKAFEEEQDLRGNLTDMEPNGVVSGM

SEQ ID NO: 490 - protein, 50 aa, Zea mays
MGPTPTAAAAGAAVAAASAAEQAAFRLVGHRNFVRFNPRSDRFHTLAFHH

That which is claimed:

1. A nucleic acid construct comprising a polynucleotide, wherein the polynucleotide comprises a nucleotide sequence encoding an HPPD polypeptide, wherein said polynucleotide encodes a polypeptide comprising
an HPPD polypeptide comprising the amino acid sequence set forth in SEQ ID NO: 411 or 438.

2. The nucleic acid construct of claim 1, wherein said polynucleotide further comprises a nucleotide sequence encoding a chloroplast transit peptide, wherein the nucleotide sequence encoding a chloroplast transit peptide comprises:
 a) a nucleotide sequence encoding the amino acid sequence set forth in SEQ ID NO: 490, 371 or 464;
 b) or, a nucleotide sequence encoding a heterologous chloroplast transit peptide sequence.

3. The nucleic acid construct of claim 1, further comprising a promoter operably linked to said polynucleotide.

4. The nucleic acid construct of claim 3, wherein said promoter is heterologous with respect to said polynucleotide or said promoter is homologous with respect to said polynucleotide.

5. A cell comprising at least one nucleic acid construct of claim 1, wherein said polynucleotide is heterologous to the cell.

6. The cell of claim 5, wherein said cell is a plant cell.

7. The cell of claim 6, wherein said nucleic acid construct is stably incorporated into the genome of said plant cell.

8. The cell of claim 6, wherein said nucleic acid construct is stably incorporated into the chloroplast genome of said plant cell.

9. The cell of claim 3, wherein said plant cell is from a monocot.

10. The cell of claim 9, wherein said monocot is maize, wheat, rice, barley, sugarcane, sorghum, or rye.

11. The cell of claim 6, wherein said plant cell is from a dicot.

12. The cell of claim 11, wherein the dicot is soybean, Brassica, sunflower, cotton, or alfalfa.

13. A plant comprising the plant cell of claim 6.

14. A plant explant comprising the plant cell of claim 6.

15. The plant of claim 13, wherein said plant exhibits an increased insensitivity to an HPPD herbicide as compared to a plant of the same species, strain or cultivar that does not comprise at least one polynucleotide comprising a nucleotide sequence encoding an HPPD polypeptide, wherein said polynucleotide encodes a polypeptide comprising an HPPD polypeptide comprising the amino acid sequence set forth in SEQ ID NO: 411 or 438.

16. The plant of claim 13, wherein the plant further comprises at least one polypeptide imparting tolerance to an additional herbicide.

17. The plant of claim 16, wherein said at least one polypeptide imparting tolerance to an additional herbicide comprises:

(a) a sulfonylurea-tolerant acetolactate synthase;
(b) an imidazolinone-tolerant acetolactate synthase;
(c) a glyphosate-tolerant 5-enolpyruvylshikimate-3-phosphate synthase;
(d) a glyphosate-tolerant glyphosate oxido-reductase;
(e) a glyphosate-N-acetyltransferase;
(f) a phosphinothricin acetyl transferase;
(g) a protoporphyrinogen oxidase;
(h) an auxin enzyme;
(i) a P450 polypeptide; or,
(j) an acetyl coenzyme A carboxylase (ACCase).

18. The plant of claim 16, wherein said at least one polypeptide imparting tolerance to an additional herbicide comprises a high resistance allele of acetolactate synthase (HRA) and/or a glyphosate-N-acetyltransferase polypeptide.

19. The plant of claim 13, wherein the plant further comprises at least one additional polypeptide imparting tolerance to an HPPD herbicide.

20. The plant of claim 19, wherein said at least one polypeptide comprises a P450 polypeptide or nicosulfuron (NSF1).

21. A transgenic seed produced by the plants of claim 13, wherein the transgenic seed comprises a nucleic acid construct comprising a polynucleotide, wherein the polynucleotide comprises a nucleotide sequence encoding an HPPD polypeptide, wherein said polynucleotide encodes a polypeptide comprising
an HPPD polypeptide comprising the amino acid sequence set forth in SEQ ID NO: 411 or 438.

22. A method of producing a 4-hydroxyphenylpyruvate dioxygenase (HPPD) herbicide tolerant plant cell comprising transforming a plant cell with the nucleic acid construct of claim 1.

23. The method of claim 22, further comprising selecting a plant cell which is resistant to an HPPD herbicide by growing plant cells in the presence of a concentration of an HPPD herbicide that bleaches said plant cell which does not comprise a nucleic acid construct comprising a polynucleotide, wherein the polynucleotide comprises a nucleotide sequence encoding an HPPD polypeptide, wherein said polynucleotide encodes a polypeptide comprising an HPPD polypeptide comprising the amino acid sequence set forth in SEQ ID NO: 411 or 438.

24. The method of claim 23, wherein said method comprises
 a) culturing said plant cell in the presence of a sufficient concentration of an HPPD herbicide such that said plant cells display bleaching;
 b) transforming into said plant cells of step (a) the nucleic acid construct comprising a polynucleotide, wherein the polynucleotide comprises a nucleotide sequence encoding an HPPD polypeptide, wherein said polynucleotide encodes a polypeptide comprising an HPPD polypeptide comprising the amino acid sequence set forth in SEQ ID NO: 411 or 438;
c) growing said plant cells of (b), wherein transformed plants cells no longer display bleaching.

25. The method of claim 22, wherein said method further comprises regenerating a transgenic plant from said plant cell.

26. The method of claim 22, wherein said transforming the plant cell results in the stable integration of the polynucleotide into the genome of a chloroplast in said plant cell.

27. A method for controlling weeds in a field containing a crop comprising:
(a) planting the field with the transgenic seeds of claim 21; and,
(b) applying to any crop and weeds in the field a sufficient amount of an HPPD herbicide to control the weeds without significantly affecting the crop.

28. The method of claim 23, wherein said HPPD herbicide comprises at least one of triketones, isoxazoles, pyrazoles, or benzobicyclon or active derivatives thereof or an agriculturally acceptable salt thereof.

29. The method of claim 28, wherein said HPPD herbicide comprises at least one of mesotrione, sulcotrione, topremezone, and tembotrione, pyrasulfotole, isoxaflutole, benzofenap, pyrazoxyfen, or pyrazolynate or active derivative thereof or an agriculturally acceptable salt thereof.

30. The method of claim 27 further comprising applying to the crop and weeds in the field a sufficient amount of at least one additional herbicide comprising glyphosate, bialaphos, phosphinothricin, azafenidin, butafenacil, sulfosate, glufosinate, an ALS inhibitor, or a protox inhibitor.

31. A nucleic acid construct comprising a polynucleotide, wherein the polynucleotide comprises a nucleotide sequence encoding an HPPD polypeptide, wherein said polynucleotide encodes a polypeptide comprising an HPPD polypeptide comprising the amino acid sequence set forth in SEQ ID NO: 411 or 438.

32. The explant of claim 14, wherein said explant exhibits an increased insensitivity to an HPPD herbicide as compared to an explant of the same species, strain or cultivar that does not comprise at least one polynucleotide, wherein the polynucleotide comprises a nucleotide sequence encoding an HPPD polypeptide, wherein said polynucleotide encodes a polypeptide comprising an HPPD polypeptide comprising the amino acid sequence set forth in SEQ ID NO: 411 or 438.

33. The explant of claim 14, wherein the plant, the explant or the plant cell further comprises at least one polypeptide imparting tolerance to an additional herbicide.

34. The explant of claim 33, wherein said at least one polypeptide imparting tolerance to an additional herbicide comprises:
(a) a sulfonylurea-tolerant acetolactate synthase;
(b) an imidazolinone-tolerant acetolactate synthase;
(c) a glyphosate-tolerant 5-enolpyruvylshikimate-3-phosphate synthase;
(d) a glyphosate-tolerant glyphosate oxido-reductase;
(e) a glyphosate-N-acetyltransferase;
(f) a phosphinothricin acetyl transferase;
(g) a protoporphyrinogen oxidase;
(h) an auxin enzyme;
(i) a P450 polypeptide; or,
(j) an acetyl coenzyme A carboxylase (ACCase).

35. The explant of claim 33, wherein said at least one polypeptide imparting tolerance to an additional herbicide comprises a high resistance allele of acetolactate synthase (HRA) and/or a glyphosate-N-acetyltransferase polypeptide.

36. The explant of claim 14, wherein the plant, the explant or the plant cell further comprises at least one additional polypeptide imparting tolerance to an HPPD herbicide.

37. The explant of claim 36, wherein said at least one polypeptide comprises a P450 polypeptide or nicosulfuron (NSF1).

38. The plant cell of claim 6, wherein said plant, explant or plant cell exhibits an increased insensitivity to an HPPD herbicide as compared to a plant, explant or plant cell of the same species, strain or cultivar that does not comprise at least one polynucleotide, wherein the polynucleotide comprises a nucleotide sequence encoding an HPPD polypeptide, wherein said polynucleotide encodes a polypeptide comprising an HPPD polypeptide comprising the amino acid sequence set forth in SEQ ID NO: 411 or 438.

39. The plant cell of claim 6, wherein the plant, the explant or the plant cell further comprises at least one polypeptide imparting tolerance to an additional herbicide.

40. The plant cell of claim 39, wherein said at least one polypeptide imparting tolerance to an additional herbicide comprises:
(a) a sulfonylurea-tolerant acetolactate synthase;
(b) an imidazolinone-tolerant acetolactate synthase;
(c) a glyphosate-tolerant 5-enolpyruvylshikimate-3-phosphate synthase;
(d) a glyphosate-tolerant glyphosate oxido-reductase;
(e) a glyphosate-N-acetyltransferase;
(f) a phosphinothricin acetyl transferase;
(g) a protoporphyrinogen oxidase;
(h) an auxin enzyme;
(i) a P450 polypeptide; or,
(j) an acetyl coenzyme A carboxylase (ACCase).

41. The plant cell of claim 39, wherein said at least one polypeptide imparting tolerance to an additional herbicide comprises a high resistance allele of acetolactate synthase (HRA) and/or a glyphosate-N-acetyltransferase polypeptide.

42. The plant cell of claim 6, wherein the plant, the explant or the plant cell further comprises at least one additional polypeptide imparting tolerance to an HPPD herbicide.

43. The plant cell of claim 42, wherein said at least one polypeptide comprises a P450 polypeptide or NSF1 nicosulfuron (NSF1).

* * * * *